United States Patent
Ganguli et al.

(10) Patent No.: US 11,884,921 B2
(45) Date of Patent: *Jan. 30, 2024

(54) SIGNAL BOOST CASCADE ASSAY

(71) Applicant: LabSimply, Inc., San Diego, CA (US)

(72) Inventors: Anurup Ganguli, San Diego, CA (US); Ashish Pandey, San Diego, CA (US); Ariana Mostafa, San Diego, CA (US); Jacob Berger, San Diego, CA (US)

(73) Assignee: VedaBio, Inc., San Diego, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 18/078,821

(22) Filed: Dec. 9, 2022

(65) Prior Publication Data

US 2023/0193273 A1 Jun. 22, 2023

Related U.S. Application Data

(60) Provisional application No. 63/397,785, filed on Aug. 12, 2022, provisional application No. 63/395,394, filed on Aug. 5, 2022, provisional application No. 63/359,183, filed on Jul. 7, 2022, provisional application No. 63/289,112, filed on Dec. 13, 2021.

(51) Int. Cl.
  *C12N 15/113* (2010.01)
  *C12N 15/10* (2006.01)
  *C12N 15/11* (2006.01)

(52) U.S. Cl.
  CPC .......... *C12N 15/113* (2013.01); *C12N 15/102* (2013.01); *C12N 15/11* (2013.01); *C12N 2310/20* (2017.05)

(58) Field of Classification Search
  CPC .... C12N 15/102; C12N 15/113; C12N 15/11; C12N 15/111; C12N 2310/20
  USPC .......... 435/6.1, 6.11, 91.1, 91.31, 455, 458; 514/44 A, 44 R; 536/23.1, 24.5
  See application file for complete search history.

(56) References Cited

U.S. PATENT DOCUMENTS

| | | |
|---|---|---|
| 10,253,365 B1 | 4/2019 | Doudna et al. |
| 10,266,886 B2 | 4/2019 | Abudayyeh et al. |
| 10,266,887 B2 | 4/2019 | Abudayyeh et al. |
| 10,337,051 B2 | 7/2019 | Doudna et al. |
| 10,494,664 B2 | 12/2019 | Doudna et al. |
| 11,021,740 B2 | 6/2021 | Abudayyeh et al. |
| 11,060,115 B2 | 7/2021 | Severinov et al. |
| 11,104,937 B2 | 8/2021 | Abudayyeh et al. |
| 11,118,224 B2 | 9/2021 | Doudna et al. |
| 11,174,470 B2 | 11/2021 | Harrington et al. |
| 11,174,515 B2 | 11/2021 | Abudayyeh et al. |
| 11,273,442 B1 | 3/2022 | Chen et al. |
| 11,421,250 B2 | 8/2022 | Severinov et al. |
| 11,447,824 B2 | 9/2022 | Doudna et al. |
| 2014/0377748 A1 | 12/2014 | Tan et al. |
| 2016/0083785 A1 | 3/2016 | Bone et al. |
| 2018/0023081 A1 | 1/2018 | Hagedorn et al. |
| 2018/0155716 A1 | 6/2018 | Zhang et al. |
| 2018/0282722 A1 | 10/2018 | Jakimo et al. |
| 2019/0112648 A1 | 4/2019 | Schaal et al. |
| 2019/0201550 A1 | 7/2019 | Maeder et al. |
| 2019/0241954 A1 | 8/2019 | Doudna et al. |
| 2019/0256900 A1 | 8/2019 | Zhang et al. |
| 2020/0010879 A1 | 1/2020 | Doudna et al. |
| 2020/0056167 A1 | 2/2020 | Dong et al. |
| 2020/0157611 A1 | 5/2020 | Qi et al. |
| 2020/0165594 A1 | 5/2020 | Zhang et al. |
| 2020/0277600 A1 | 9/2020 | Zhang et al. |
| 2020/0392473 A1 | 12/2020 | Zhang et al. |
| 2021/0102183 A1 | 4/2021 | Cameron et al. |
| 2021/0102242 A1 | 4/2021 | Chen et al. |
| 2021/0108267 A1 | 4/2021 | Zhang et al. |
| 2021/0163944 A1 | 6/2021 | Zhang et al. |
| 2021/0166783 A1 | 6/2021 | Shmakov et al. |
| 2021/0269866 A1 | 9/2021 | Zhang et al. |
| 2021/0317527 A1 | 10/2021 | Doudna et al. |
| 2021/0388437 A1 | 12/2021 | Doudna et al. |
| 2022/0025463 A1 | 1/2022 | Abudayyeh et al. |
| 2022/0333208 A1 | 10/2022 | Gootenberg et al. |
| 2023/0193368 A1 | 6/2023 | Rananaware et al. |

FOREIGN PATENT DOCUMENTS

| | | |
|---|---|---|
| CN | 114058679 A | 2/2022 |
| CN | 114262730 A | 4/2022 |
| WO | WO 2014/143228 A1 | 9/2014 |
| WO | WO 2016/201138 A1 | 12/2016 |
| WO | WO 2020/191248 | 9/2020 |

(Continued)

OTHER PUBLICATIONS

Collias et al (Nature Communication, vol. 12, No. 555, pp. 1-12 (2021)) (Year: 2021).*
Liu et al (Trends in Biotechnology, vol. 39, No. 3, pp. 262-273 (2021)) (Year: 2021).*
U.S. Appl. No. 18/078,031.*
U.S. Appl. No. 18/208,262.*
International Search Report and Written Opinion for International Application No. PCT/US22/52320, dated Jun. 15, 2023, p. 1-46.
Mullally, et al., "5' modifications to CRISPR-Cas9 gRNA can change the dynamics and size of R-loops and inhibit DNA cleavage", Nucleic Acids Research, Jun. 2020, vol. 48, No. 12, pp. 6811-6823; DOI: 10.1093/nar/gkaa477.

(Continued)

*Primary Examiner* — Jane J Zara
(74) *Attorney, Agent, or Firm* — Sarah Brashears

(57) ABSTRACT

The present disclosure relates to compositions of matter and assay methods used to detect one or more target nucleic acids of interest in a sample. The compositions and methods provide signal boost upon detection of target nucleic acids of interest in less than one minute and in some instances instantaneously at ambient temperatures down to 16° C. or less, without amplification of the target nucleic acids yet allowing for massive multiplexing, high accuracy and minimal non-specific signal generation.

5 Claims, 42 Drawing Sheets

Specification includes a Sequence Listing.

(56) References Cited

FOREIGN PATENT DOCUMENTS

| | | |
|---|---|---|
| WO | WO 2020/191376 | 9/2020 |
| WO | WO 2021/021532 A1 | 2/2021 |
| WO | WO 2021/108717 A2 | 6/2021 |
| WO | WO 2021/146534 A1 | 7/2021 |
| WO | WO 2021/236651 A1 | 11/2021 |
| WO | WO 2022/061166 A1 | 3/2022 |
| WO | WO 2022/133108 A2 | 6/2022 |
| WO | WO 2022/266513 A2 | 12/2022 |
| WO | WO 2023/278629 A1 | 1/2023 |
| WO | WO 2023/287669 A2 | 1/2023 |
| WO | WO 2023/015259 A2 | 2/2023 |
| WO | WO 2023/056451 A1 | 4/2023 |
| WO | WO 2023/081902 A1 | 5/2023 |
| WO | WO 2023/114052 A1 | 6/2023 |
| WO | WO 2023/114090 A2 | 6/2023 |

OTHER PUBLICATIONS

Hong, et al., "Comparison and optimization of CRISPR/dCas9/gRNA genome-labeling systems for live cell imaging", Genome Biology, 2018, pp. 7-8, DOI: 10.1186/s13059-018-1413-5.

Li, et al., "CRISPR-Cas 12a has both cis- and trans-cleavage activities on single-stranded DNA", Cell Research, Mar. 2018, p. 1, DOI: 10.1038/s41422-018-0022-x.

Dong, et al., "An anti-CRISPR protein disables type V Cas12a by acetylation", PubMed, p. 1, DOI: 10.1038/s41594-019-0206-1.

Nguyen, et al., "Enhancement of trans-cleavage activity of Cas12a with engineered crRNA enables amplified nucleic acid detection", Nature Communications, 2020, p. 1-15, DOI: 10.1038/s41467-020-18615-1.

Coehlo, et al., "CRISPR Guard protects off-target sites from Cas9 nuclease activity using short guide RNAs", Nature Communications, 2020, p. 1-12, DOI: 10.1038/s41467-020-17952-5.

East-Seletsky, et al., "RNA targeting by functionally orthogonal Type VI-A CRISPR-Cas enzymes", Howard Hughes Medical Institute, Mol Cell, pp. 373-383, May 4, 2017.

Schmidt, et al., "Application of locked nucleic acids to improve aptamer in vivo stability and targeting function", Nucleic Acids Research, vol. 32, No. 19, doi:10.1093/nar/gkh862, pp. 5757-5765, Oct. 27, 2004.

Makarova, et al., "Evolutionary classification of CRISPR-Cas systems: a burst of class 2 and derived variants", Nature Reviews | Microbiology, vol. 18, pp. 67-83, Feb. 2020.

Gleditzsch, et al., "PAM identification by CRISPR-Cas effector complexes: diversified mechanisms and structures", RNA Biology, vol. 16, No. 4, doi.org/10.1080/15476286.2018.1504546, pp. 504-517, Jul. 20, 2018.

Kellner, et al., "SHERLOCK: Nucleic acid detection with CRISPR nucleases", Nat Protoc., doi:10.1038/s41596-019-0210-2, pp. 2986-3012, Oct. 2019.

Fozouni, et al., "Amplification-free detection of SARS-COV-2 with CRISPR-Cas13a and mobile phone microscopy", Cell, doi.org/10.1016/j.cell.2020.12.001, pp. 323-333, Jan. 21, 2021.

Kaminski, et al., "CRISPR-based diagnostics", Nature Biomedical Engineering, vol. 5, doi.org/10.1038/s41551-021-00760-7, pp. 643-656, Jul. 2021.

Zhou, et al., "CRISPR/Cas13a Powered Portable Electrochemiluminescence Chip for Ultrasensitive and Specific MiRNA Detection", Advanced Science News, doi: 10.1002/advs.201903661, pp. 1-10, 2020.

Zhao, et al., "CRISPR-Cas13a system: A novel tool for molecular diagnostics", Frontiers in Microbiology, doi:10.3389/fmicb.2022.1060947, pp. 1-18, Dec. 8, 2022.

Zhou, et al., "A Decade of CRISPR Gene Editing in China and Beyond: A Scientometric Landscape", The CRISPR Journal, vol. 4, No. 3, doi:10.1089/crispr.2020.0148, pp. 313-320, 2021.

Shinoda, et al., "Automated amplification-free digital RNA detection platform for rapid and sensitive SARS-CoV-2 diagnosis", Communications Biology, doi.org/10.1038/s42003-022-03433-6, pp. 1-8, May 26, 2022.

Gupta, et al., "Cas13d: A New Molecular Scissor for Transcriptome Engineering", Frontiers in Cell and Developmental Biology, vol. 10, doi:10.3389/fcell.2022.866800, pp. 1-22, Mar. 31, 2022.

Schunder, et al., "First indication for a functional CRISPR/Cas system in Francisella tularensis", International Journal of Medical Microbiology, vol. 303, Issue 2, doi:10.1016/j.ijmm.2012.11.004, pp. 1-29, Mar. 2013.

Sha, et al., "Cascade CRISPR/cas enables amplification-free microRNA sensing with fM-sensitivity and single-base-specificity", ChemComm, doi:10.1039/d0cc06412b, pp. 247-250 and 1-15, 2021.

Yang, et al., "Engineered LwaCas13a with enhanced collateral activity for nucleic acid detection", Nature Chemical Biology, vol. 19, doi:10.1038/s41589-022-01135-y, pp. 45-54, Jan. 2023.

International Search Report and Written Opinion for International Application No. PCT/US2022/036610, dated Jun. 29, 2023, p. 1-93.

International Search Report and Written Opinion for International Application No. PCT/US2022/052032, dated Apr. 18, 2023, p. 1-19.

Zhang, et al, "An aM-level cascade CRISPR-Dx system (ASCas) for rapid detection of RNA without pre-amplification", Biosensors and Bioelectronics, doi:10.1016/j.bios.2023.115248, Mar. 28, 2023, p. 1-5.

Zeng, et al., "Rapid RNA detection through intra-enzyme chain replacement-promoted Cas13a cascade cyclic reaction without amplification", Analytica Chimica Acta, doi:10.1016/j.aca.2022.340009, May 31, 2022, p. 1-10.

Huyke, et al., "Enzyme Kinetics and Detector Sensitivity Determine Limits of Detection of Amplification-Free CRISPR-Cas12 and CRISPR-Cas13 Diagnostics", Analytical Chemistry, doi:10.1021/acs.analchem.2601670, Jun. 27, 2022, p. 9826-9834.

Li, et al., "Applying CRISPR-Cas12a as Signal Amplifier to Construct Biosensors for Non-DNA Targets in Ultra-low Concentrations", ACS Sensors, doi: 10.1021/acssensors.9b02305, pp. 1-23, Mar. 12, 2020.

Kim, et al., "Chimeric crRNAs with 19 DNA residues in the guide region show retained DNA cleavage activity of Cas9 with a potential to improve the specificity", The Royal Society of Chemistry, pp. 1-16, 2019.

Kim, et al., "Enhancement of target specificity of CRISPR-Cas12a by using a chimeric DNA-RNA guide", Nucleic Acids Research, doi: 10.1093/nar/gkaa605, vol. 48, No. 15, pp. 8601-8616, Jul. 20, 2020.

Swarts, et al., "Mechanistic Insights into the Cis- and Trans-acting Deoxyribonuclease Activities of Cas12a", Mol Cell, doi: 10.1016/j.molcel.2018.11.021, pp. 1-28, Feb. 7, 2019.

Nguyen, et al., "Enhancement of trans-cleavage activity of Cas12a with engineered crRNA enables amplified nucleic acid detection", Nature Communications, doi: 10.1038/s41467-020-18615-1, pp. 1-13, 2020.

Ooi, et al., "An engineered CRISPR-Cas12a variant and DNA-RNA hybrid guides enable robust and rapid COVID-10 testing", Nature Communications, doi: 10.1038/s41467-021-21996-6, pp. 1-23, 2021.

Shi, et al., "A CRISPR-Cas autocatalysis-driven feedback amplification network for supersensitive DNA diagnostics", Science Advances, doi: 10.1126/sciadv.abc7802, pp. 1-9, Jan. 27, 2021.

The Board of Trustees of the University of Illinois, "CRISPR Cascade", International PCT Application No. PCT/US22/33985, filed Jun. 17, 2022.

Chen, et al., "CRISPR-Cas12a target binding unleashes indiscriminate single-stranded DNase activity", Howard Hughes Medical Institute, Science, 360(6387), pp. 436-439, Apr. 27, 2018.

Liu, et al., "Accelerated RNA detection using tandem CRISPR nucleases", Nature Chemical Biology, vol. 17, doi:10.1038/s41589-021-0084202, pp. 982-988, Sep. 2021.

Gootenberg, et al., "Nucleic acid detection with CRISPR-Cas13a/C2c2", Science, doi:10.1126/science.aam9321, pp. 438-442, Apr. 28, 2017.

\* cited by examiner

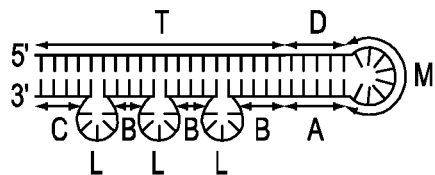 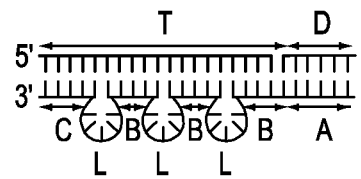
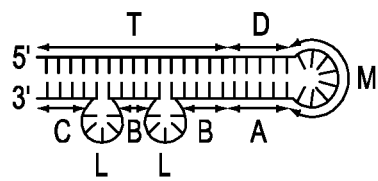 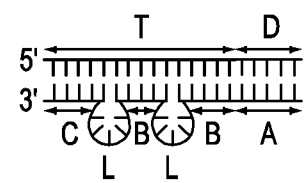
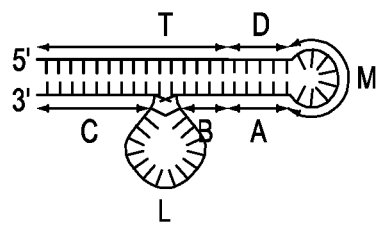 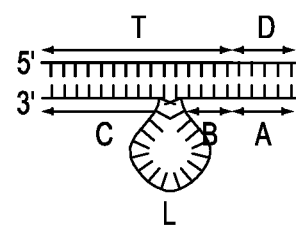
FIG. 2E
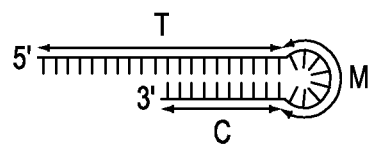
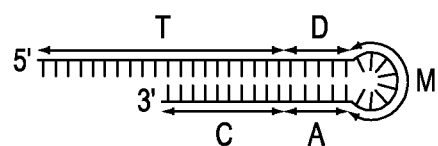
FIG. 2F

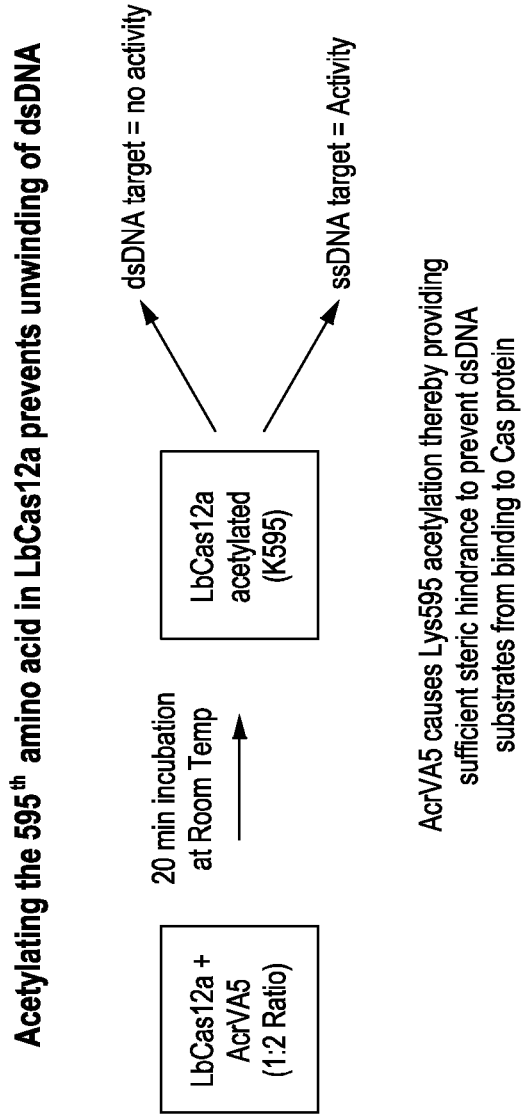

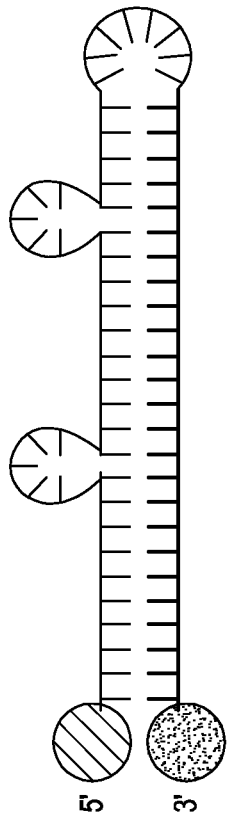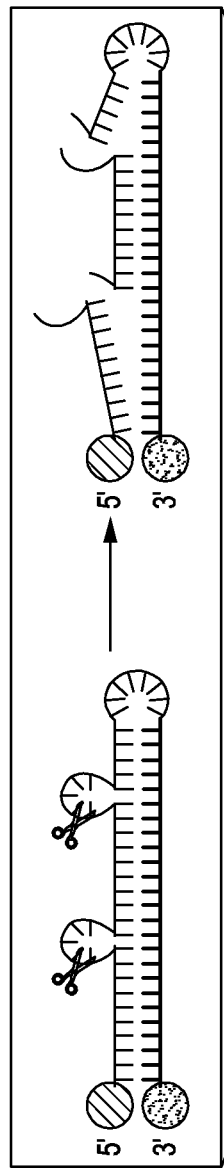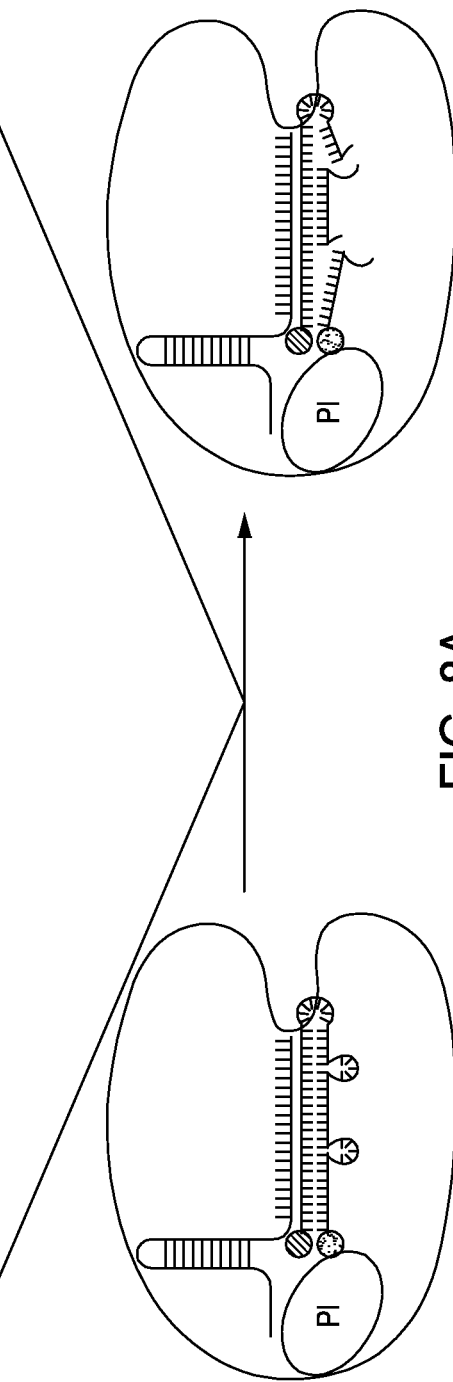
FIG. 8A

LIST OF EXEMPLARY MODIFIERS

| Modification Group | Modification | Structure |
|---|---|---|
| 5' Modification | 5' - Fam (6-fluorescein amidite (6-FAM)) | 5'-Fluorescein (6 FAM) [26-6431-XX] |
| | BHQ-1 (Black Hole Quencher-1,5') | Black Hole Quencher 1 (BHQ-1) [26-6472-XX] |
| | Biotin TEG (15 atom triethylene glycol spacer) | 5'-Biotin TEG [26-6407-XX] |
| | Biotin-5' | Biotin [26-6423-XX] |
| | Cholesterol TEG (15 atom triethylene glycol spacer) | Cholesterol TEG [26-6602-XX] |

FIG. 8C

LIST OF EXEMPLARY MODIFIERS (CONT)

| Modification Group | Modification | Structure |
|---|---|---|
| 3' Modification | BHQ-1 (Black Hole Quencher-1,3') | Black Hole Quencher 1 (BHQ-1) [26-6472-XX] |
| | Biotin-3' | |
| | TAMRA-3' (Carboxytetramethyl-lrhodamine) | |
| Internal Modification (Btwn bases) | Cy3 Internal | 3'-TAMRA (Carboxytetramethylrhodamine) [26-6451-XX] |
| | Cy5 Internal | |

FIG. 8D

LIST OF EXEMPLARY MODIFIERS

| Modification Group | Modification | Structure |
|---|---|---|
| Nucleotide Base Modification | Biotin deoxythymidine dT | Biotin dT [26-6424-XX] |
| | Desthiobiotin NHS | Desthiobiotin (NHS Ester) [26-6713-XX] |
| | Fluorescein dT (Fam dT) | deoxythymidine dT [26-6400-XX] / Fluorescein dT [26-6422-XX] |

FIG. 8E

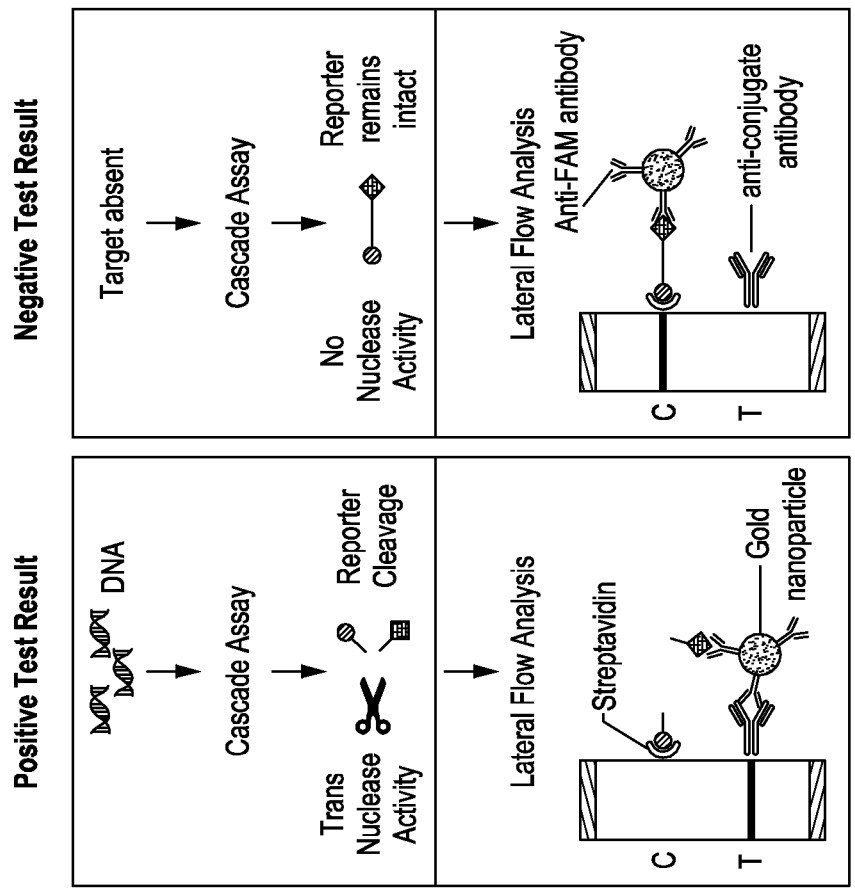
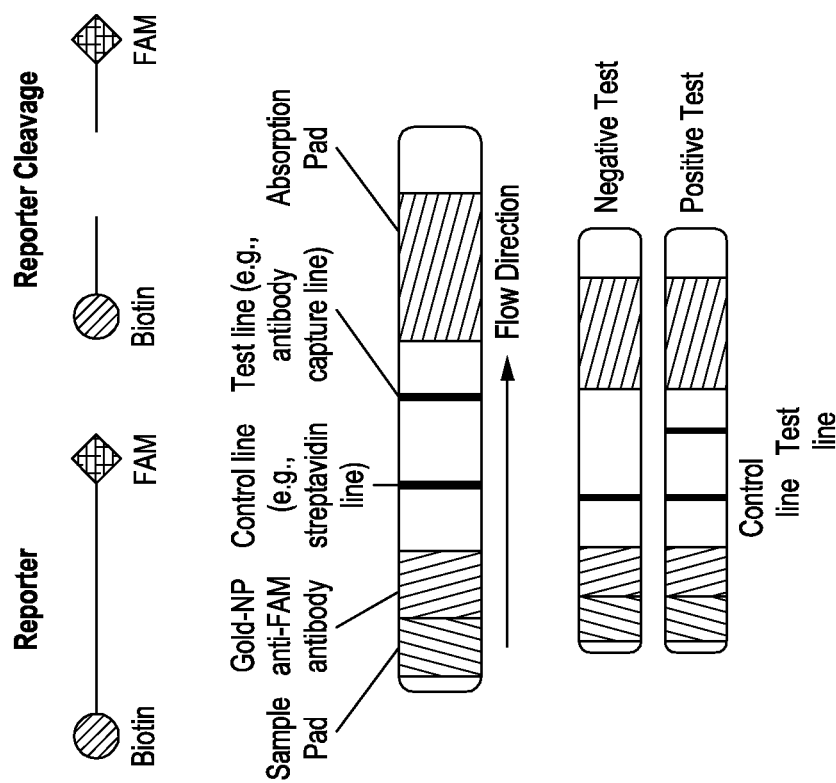
FIG. 9

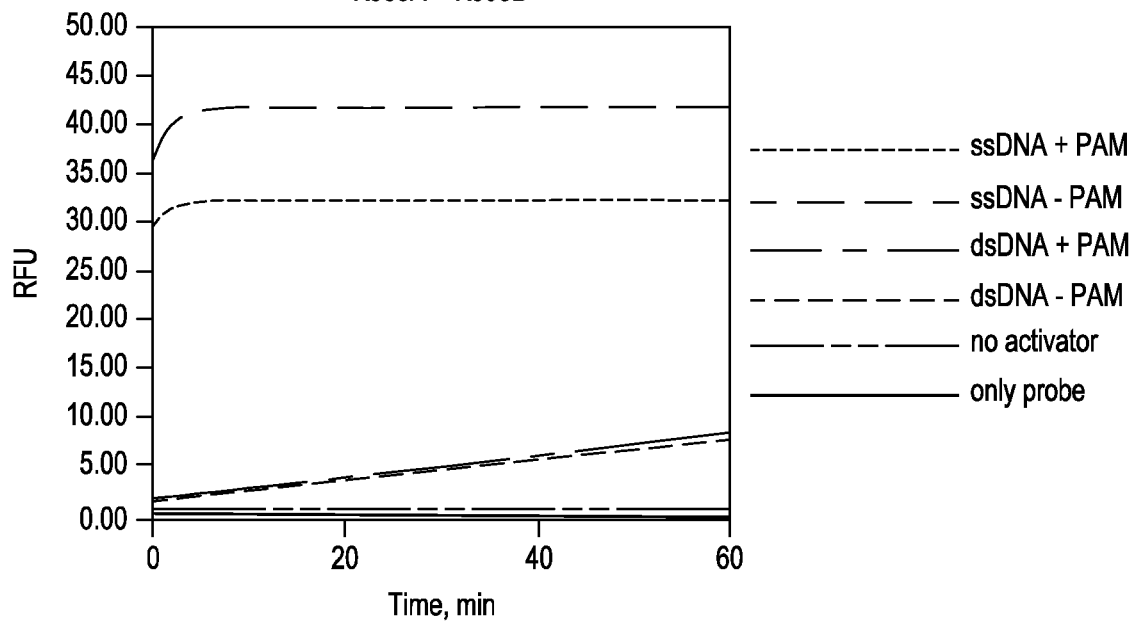
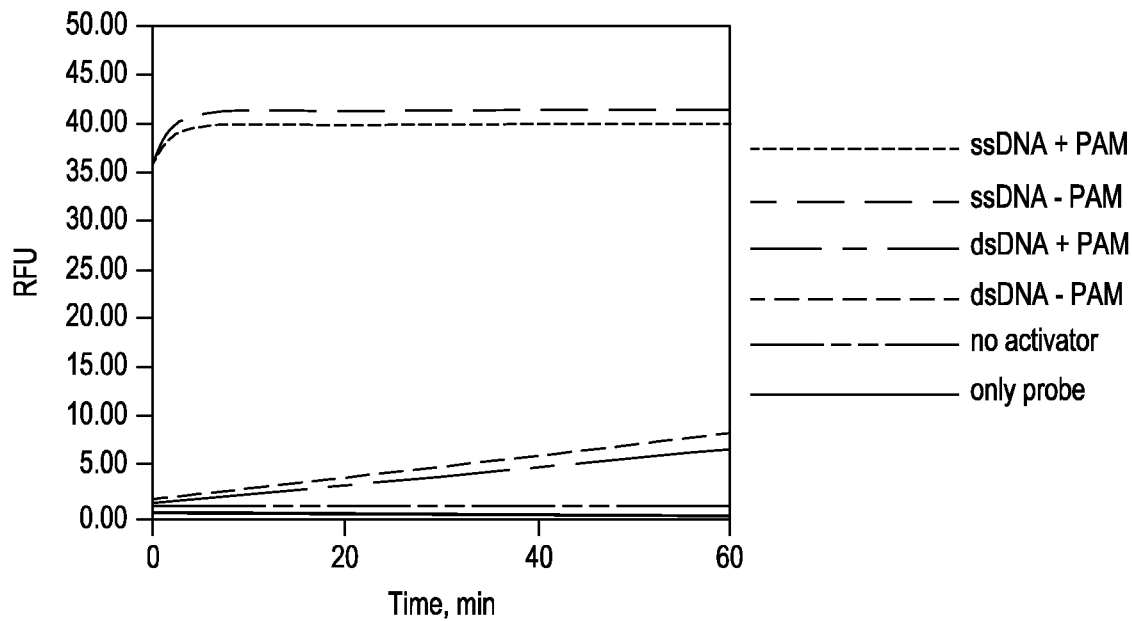
FIG. 12D

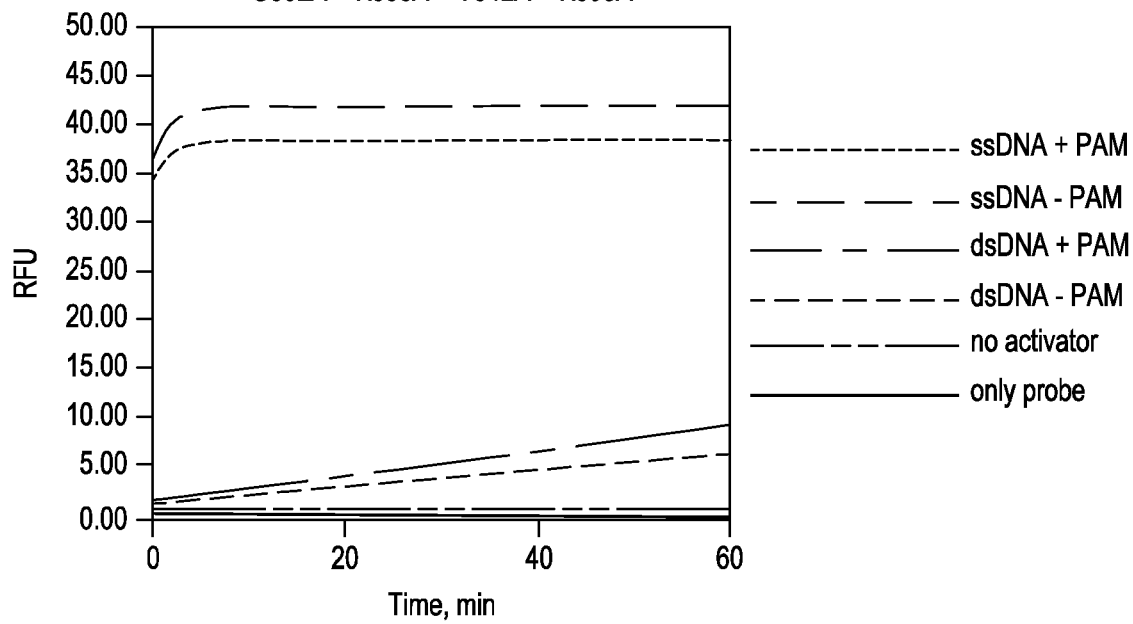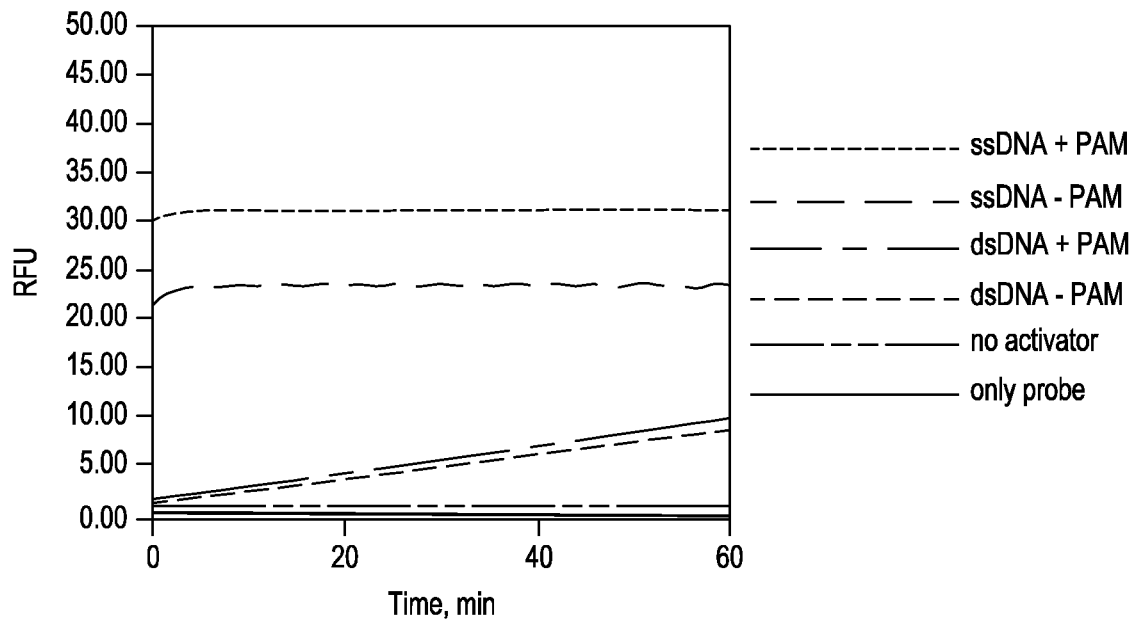
FIG. 12E

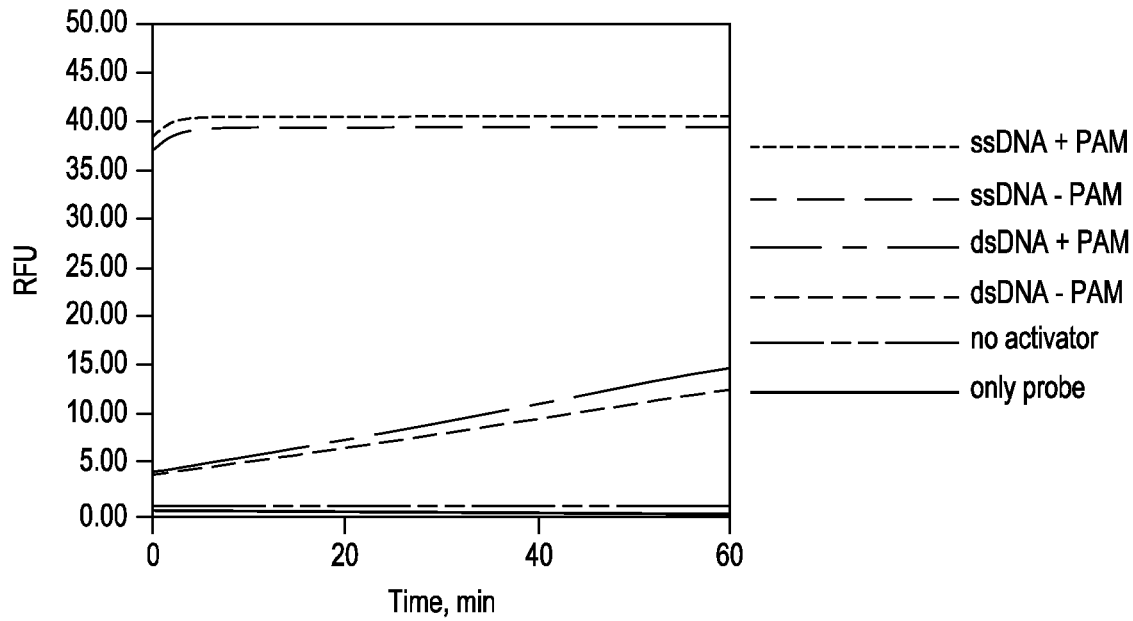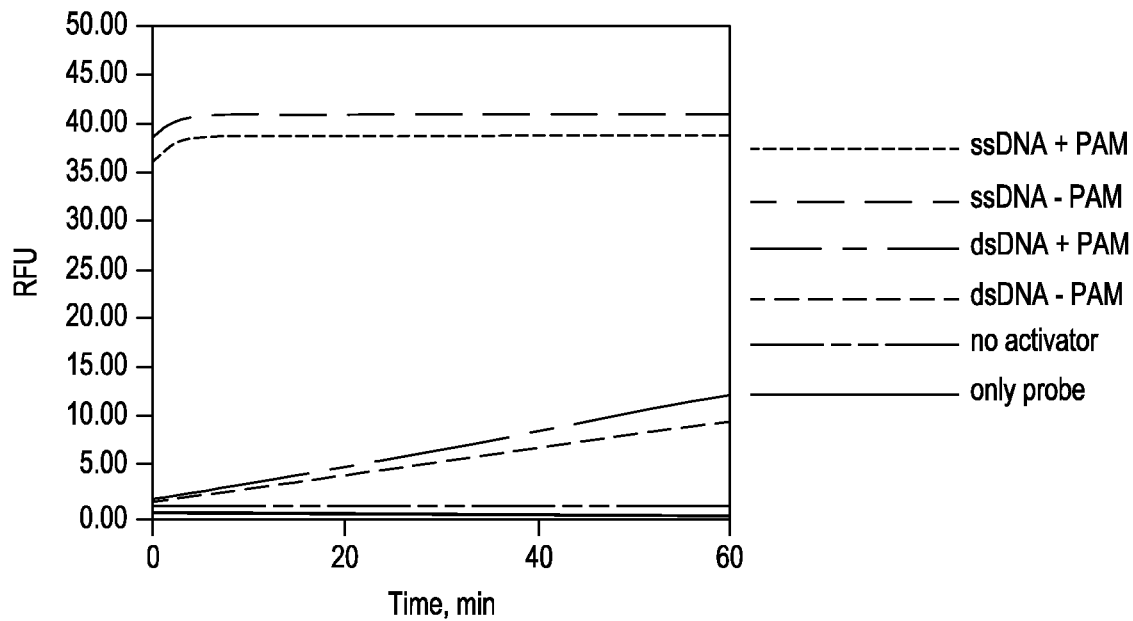
FIG. 12F

US 11,884,921 B2

SIGNAL BOOST CASCADE ASSAY

RELATED APPLICATIONS

This application claims priority to U.S. Ser. No. 63/289,112, filed 13 Dec. 2021; U.S. Ser. No. 63/359,183, filed 7 Jul. 2022; U.S. Ser. No. 63/395,394, filed 5 Aug. 2022; and U.S. Ser. No. 63/397,785, filed 12 Aug. 2022.

INCORPORATION BY REFERENCE OF SEQUENCE LISTING

Submitted herewith is an electronically filed sequence listing via EFS-Web a Sequence Listing XML, entitled "LS004US1_seglist_20221201", created 1 Dec. 2022, which is 1,227,000 bytes in size. The sequence listing is part of the specification of this specification and is incorporated by reference in its entirety.

PETITION UNDER 37 CFR 1.84(a)(2)

This patent application contains at least one drawing executed in color. The color drawings are necessary as the only practical medium by which aspects of the claimed subject matter may be accurately conveyed. The claimed invention relates to variant proteins that alter the active site thereof and the color drawings are necessary to easily discern the structural difference between variants. As the color drawings are being filed electronically via EFS-Web, only one set of the drawings is required.

FIELD OF THE INVENTION

The present disclosure relates to compositions of matter and assay methods used to detect one or more target nucleic acids of interest in a sample. The compositions and methods provide a signal boost upon detection of target nucleic acids of interest in less than one minute and at ambient temperatures down to 16° C. or less.

BACKGROUND OF THE INVENTION

In the following discussion certain articles and methods will be described for background and introductory purposes. Nothing contained herein is to be construed as an "admission" of prior art. Applicant expressly reserves the right to demonstrate, where appropriate, that the articles and methods referenced herein do not constitute prior art under the applicable statutory provisions.

Rapid and accurate identification of, e.g., infectious agents, microbe contamination, variant nucleic acid sequences that indicate the present of diseases such as cancer or contamination by heterologous sources is important in order to select correct treatment; identify tainted food, pharmaceuticals, cosmetics and other commercial goods; and to monitor the environment including identification of biothreats. Classic PCR and nucleic acid-guided nuclease or CRISPR (clustered regularly interspaced short palindromic repeats) detection methods rely on pre-amplification of target nucleic acids of interest to enhance detection sensitivity. However, amplification increases time to detection and may cause changes to the relative proportion of nucleic acids in samples that, in turn, lead to artifacts or inaccurate results. Improved technologies that allow very rapid and accurate detection of nucleic acids are therefore needed for timely diagnosis and treatment of disease, to identify toxins in consumables and the environment, as well as in other applications.

SUMMARY OF THE INVENTION

This Summary is provided to introduce a selection of concepts in a simplified form that are further described below in the Detailed Description. This Summary is not intended to identify key or essential features of the claimed subject matter, nor is it intended to be used to limit the scope of the claimed subject matter. Other features, details, utilities, and advantages of the claimed subject matter will be apparent from the following written Detailed Description including those aspects illustrated in the accompanying drawings and defined in the appended claims.

The present disclosure provides compositions of matter and assay methods to detect target nucleic acids of interest. The "nucleic acid-guided nuclease cascade assays" or "signal boost cascade assays" or "cascade assays" described herein comprise two different ribonucleoprotein complexes and either blocked nucleic acid molecules or blocked primer molecules. The blocked nucleic acid molecules or blocked primer molecules keep one of the ribonucleoprotein complexes "locked" unless and until a target nucleic acid of interest activates the other ribonucleoprotein complex. The present nucleic acid-guided nuclease cascade assay can detect one or more target nucleic acids of interest (e.g., DNA, RNA and/or cDNA) at attamolar (aM) (or lower) limits in less than one minute and in some embodiments virtually instantaneously without the need for amplifying the target nucleic acid(s) of interest, thereby avoiding the drawbacks of multiplex DNA amplification, such as primer-dimerization. Further, the cascade assay prevents "leakiness" that can lead to non-specific signal generation resulting in false positives by preventing unwinding of the blocked nucleic acid molecules or blocked primer molecules (double-stranded molecules); thus, the cascade assay is quantitative in addition to being rapid. A particularly advantageous feature of the cascade assay is that, with the exception of the gRNA in RNP1, the cascade assay components are the same in each assay no matter what target nucleic acid(s) of interest is being detected; moreover, the gRNA in the RNP1 is easily reprogrammed using traditional guide design methods.

The present disclosure is related first, to the instantaneous cascade assay, and second, to three modalities for preventing any "leakiness" in the cascade assay leading to false positives. The three modalities enhance the cascade assay and are in addition to using blocked nucleic acid molecules or blocked primer molecules in the cascade assay.

A first embodiment provides a method for identifying a target nucleic acid of interest in a sample in one minute or less at 16° C. or more comprising the steps of: providing a reaction mixture comprising: first ribonucleoprotein complexes (RNP1s) each comprising a first nucleic acid-guided nuclease and a first gRNA, wherein the first gRNA comprises a sequence complementary to the target nucleic acid of interest; and wherein binding of the RNP1 complex to the target nucleic acid of interest activates cis-cleavage and trans-cleavage activity of the first nucleic acid-guided nuclease; second ribonucleoprotein complexes (RNP2s) comprising a second nucleic acid-guided nuclease and a second gRNA that is not complementary to the target nucleic acid of interest; wherein the second nucleic acid-guided nuclease optionally comprises a variant nuclease engineered such that single stranded DNA is cleaved faster than double stranded DNA is cleaved, wherein the variant nuclease comprises at least one mutation to the domains that interact with the PAM region or surrounding sequences on blocked nucleic acid molecules, and wherein the variant nuclease exhibits both cis- and trans-cleavage activity; a plurality of the blocked nucleic acid molecules comprising a sequence corresponding to the second gRNA, wherein the blocked nucleic acid molecules comprise: a first region recognized by the RNP2 complex; one or more second regions not complementary to the first region forming at least one loop; one or more third regions complementary to and hybridized to the first region forming at least one clamp, wherein the plurality of blocked nucleic acid molecules and the RNP2s optionally are at a concentration ratio where the blocked nucleic acid molecules are at an equal or higher molar concentration than the RNP2s in the reaction mixture, wherein the blocked nucleic acid molecules optionally each comprise at least one bulky modification, and wherein the reaction mixture comprises at least one of a variant nuclease, the concentration ratio of the blocked nucleic acid molecules at a higher molar concentration than the molar concentration of RNP2s in the reaction mixture, and/or the blocked nucleic acid molecules comprise at least one bulky modification; contacting the reaction mixture with the sample under conditions that allow the target nucleic acid of interest in the sample to bind to RNP1, wherein upon binding of the target nucleic acid of interest RNP1 becomes active initiating trans-cleavage of at least one of the plurality of blocked nucleic acid molecules thereby producing at least one unblocked nucleic acid molecule, and wherein the at least one unblocked nucleic acid molecule binds to RNP2 initiating trans-cleavage of at least one further blocked nucleic acid molecule; and detecting the cleavage products, thereby detecting the target nucleic acid of interest in the sample in one minute or less.

An additional embodiment provides a method for identifying a target nucleic acid of interest in a sample in one minute or less at 16° C. or more comprising the steps of: providing a reaction mixture comprising: first ribonucleoprotein complexes (RNP1s), wherein the RNP1s comprise a first nucleic acid-guided nuclease and a first guide RNA (gRNA); wherein the first gRNA comprises a sequence complementary to the nucleic acid target of interest, and wherein the first nucleic acid-guided nuclease exhibits both cis-cleavage activity and trans-cleavage activity; second ribonucleoprotein complexes (RNP2s) comprising a second nucleic acid-guided nuclease and a second gRNA that is not complementary to the target nucleic acid of interest; wherein the second nucleic acid-guided nuclease optionally comprises a variant nuclease engineered such that single stranded DNA is cleaved faster than double stranded DNA is cleaved, wherein the variant nuclease comprises at least one mutation to the domains that interact with the PAM region or surrounding sequences on a synthesized activating molecule, and wherein the variant nuclease exhibits both cis- and trans-cleavage activity; a plurality of template molecules comprising sequence homology to the second gRNA; a plurality of the blocked primer molecules comprising a sequence complementary to the template molecules, wherein the blocked primer molecules cannot be extended by a polymerase, and wherein the blocked primer molecules comprise: a first region recognized by the RNP2; one or more second regions not complementary to the first region forming at least one loop; and one or more third regions complementary to and hybridized to the first region forming at least one clamp, wherein the plurality of blocked primer molecules and the RNP2s optionally are at a concentration ratio where the blocked nucleic acid molecules are at a higher molar concentration than the RNP2s in the reaction mixture, wherein the blocked primer molecules each optionally comprise at least one bulky modification, and wherein the reaction mixture comprises at least one of a variant nuclease, a concentration ratio where the blocked nucleic acid molecules are at a higher molar concentration than the RNP2s in the reaction mixture, and/or the blocked nucleic acid molecules comprising at least one bulky modification; and a polymerase and a plurality of nucleotides; contacting the reaction mixture with the sample under conditions that allow nucleic acid targets of interest in the sample to bind to RNP1, wherein: upon binding of the nucleic acid targets of interest to the RNP1, the RNP1 becomes active trans-cleaving at least one of the blocked primer molecules, thereby producing at least one unblocked primer molecule that can be extended by the polymerase; the at least one unblocked primer molecule binds to one of the template molecules and is extended by the polymerase and nucleotides to form at least one synthesized activating molecule having a sequence complementary to the second gRNA; and the at least one synthesized activating molecule binds to the second gRNA, and RNP2 becomes active cleaving at least one further blocked primer molecule and at least one reporter moiety in a cascade; allowing the cascade to continue; and detecting the unblocked primer molecules, thereby detecting the target nucleic acid of interest in the sample in one minute or less.

Aspects of the embodiments of the methods for identifying a target nucleic acid of interest in a sample in one minute or less can be substituted for any assay for identifying target nucleic acids; for example, for detecting human pathogens; animal pathogens; disease biomarkers; pathogens in laboratories, food processing facilities, hospitals, and in the environment, including bioterrorism applications (see the exemplary organisms listed in Tables 1, 2, 3, 5 and 6 and the exemplary human biomarkers listed in Table 4). Suitable samples for testing include any environmental sample, such as air, water, soil, surface, food, clinical sites and products, industrial sites and products, pharmaceuticals, medical devices, nutraceuticals, cosmetics, personal care products, agricultural equipment and sites, and commercial samples, and any biological sample obtained from an organism or a part thereof, such as a plant, animal (including humans), or microbe.

There is also provided in an embodiment a method of detecting a target nucleic acid molecule in a sample in a cascade reaction comprising the steps of: (a) providing a reaction mixture comprising: (i) a first ribonucleoprotein complex (RNP1) comprising a first nucleic acid-guided nuclease and a first guide RNA (gRNA) comprising a sequence complementary to a target nucleic acid molecule; (ii) a second ribonucleoprotein complex (RNP2) comprising a second nucleic acid-guided nuclease and a second gRNA that is not complementary to the target nucleic acid molecule; and (iii) a plurality of blocked nucleic acid molecules comprising a sequence complementary to the second guide RNA, (b) contacting the target nucleic acid molecule with the reaction mixture under conditions that, relative to a control reaction, reduce the probability of R-loop formation between the second gRNA and the plurality of blocked nucleic acid molecules, wherein: (i) upon binding of the target nucleic acid molecule, the RNP1 becomes active wherein the first nucleic acid-guided nuclease cleaves at least one of the blocked nucleic acid molecules, thereby producing at least one unblocked nucleic acid molecule; and (ii) at least one unblocked nucleic acid molecule binds to the second gRNA, and the RNP2 becomes active wherein the second nucleic acid-guided nuclease cleaves at least one further blocked nucleic acid molecule; and (c) detecting the cleavage products of step (b), thereby detecting the target nucleic acid molecule in the sample.

There is also provided a second embodiment comprising a method of increasing the efficiency, reducing the background, increasing the signal-to-noise ratio, reducing cis-cleavage of blocked nucleic acid molecules and preventing unwinding of the second ribonucleoprotein complex (RNP2) in a cascade reaction comprising: (a) a reaction mixture comprising: (i) a first ribonucleoprotein complex (RNP1) comprising a first nucleic acid-guided nuclease and a first guide RNA (gRNA) comprising a sequence complementary to a target nucleic acid molecule; (ii) the RNP2 comprising a second nucleic acid-guided nuclease and a second gRNA that is not complementary to the target nucleic acid molecule; and (iii) a plurality of blocked nucleic acid molecules comprising a sequence complementary to the second guide RNA, and (b) the target nucleic acid molecule comprising a sequence complementary to the first gRNA; and the method comprising the step of initiating the cascade reaction by contacting (a) and (b) under conditions that reduce the probability of R-loop formation between the blocked nucleic acid molecules and the second gRNA, thereby reducing increasing the efficiency, reducing the background, increasing the signal-to-noise ratio, reducing cis-cleavage of blocked nucleic acid molecules and preventing unwinding of the RNP2 relative to a control reaction.

There is also provided in a third embodiment a method of increasing the signal-to-noise ratio in a cascade reaction comprising the steps of: (a) providing a reaction mixture comprising: (i) a first ribonucleoprotein complex (RNP1) comprising a first nucleic acid-guided nuclease and a first guide RNA (gRNA) comprising a sequence complementary to a target nucleic acid molecule; (ii) a second ribonucleoprotein complex (RNP2) comprising a second nucleic acid-guided nuclease and a second gRNA that is not complementary to the target nucleic acid molecule; and (iii) a plurality of blocked nucleic acid molecules comprising a sequence complementary to the second guide RNA, (b) initiating the cascade reaction by contacting the target nucleic acid molecule with the reaction mixture under conditions that reduce the probability of R-loop formation between the second gRNA and the plurality of blocked nucleic acid molecules, thereby increasing the signal-to-noise ratio in the cascade reaction relative to a control reaction, wherein: (i) upon binding of the target nucleic acid molecule, the RNP1 becomes active cleaving at least one of the blocked nucleic acid molecules, thereby producing at least one unblocked nucleic acid molecule; and (ii) the least one unblocked nucleic acid molecule binds to the second gRNA, and the RNP2 becomes active cleaving at least one further blocked nucleic acid molecule; and (c) detecting the cleavage products of the cascade reaction in step (b); and (d) determining the signal-to-noise ratio of the cascade reactions in step (b).

A fourth embodiment provides a method of increasing the efficiency, reducing the background, increasing the signal-to-noise ratio, reducing cis-cleavage of blocked nucleic acid molecules and preventing unwinding of a second ribonucleoprotein complex (RNP2) in a cascade reaction comprising the steps of: (a) providing a reaction mixture comprising: a first ribonucleoprotein complex (RNP1) comprising a first nucleic acid-guided nuclease and a first guide RNA (gRNA) comprising a sequence complementary to a target nucleic acid molecule; the RNP2 comprising a second nucleic acid-guided nuclease and a second gRNA that is not complementary to the target nucleic acid molecule; and a plurality of blocked nucleic acid molecules comprising a sequence complementary to the second guide RNA, (b) initiating the cascade reaction by contacting the target nucleic acid molecule with the reaction mixture under conditions that reduce the probability of R-loop formation between the second gRNA and the plurality of blocked nucleic acid molecules, thereby increasing the efficiency, reducing the background, increasing the signal-to-noise ratio, reducing cis-cleavage of blocked nucleic acid molecules and preventing unwinding of the RNP2 in the cascade reaction relative to a control reaction.

In some aspects of these embodiments, the conditions that reduce R-loop formation comprise one or more of the steps of: 1) providing a molar concentration of blocked nucleic acid molecules that exceeds the molar concentration of ribonucleoprotein complexes; 2) engineering the nucleic acid-guided nuclease used in the ribonucleoprotein complex to result in a variant nucleic acid-guided nuclease such that single stranded DNA is cleaved faster than double stranded DNA is cleaved; and/or 3) engineering the blocked nucleic acid molecules to include bulky modifications of a size of about 1 nm or less.

Another embodiment provides a method for preventing unwinding of blocked nucleic acid molecules in the presence of an RNP in a cascade reaction comprising the steps of: providing blocked nucleic acid molecules; providing ribonucleoprotein complexes comprising a nucleic acid-guided nuclease that exhibits both cis- and trans-cleavage activity upon activation and a gRNA that recognizes an unblocked nucleic acid molecule resulting from trans-cleavage of the blocked nucleic acid molecules; and providing a molar concentration of the blocked nucleic acid molecules that exceeds the molar concentration of ribonucleoprotein complexes; engineering the nucleic acid-guided nuclease used in the ribonucleoprotein complex to result in a variant nucleic acid-guided nuclease such that single stranded DNA is cleaved faster than double stranded DNA is cleaved; and/or 3) engineering the blocked nucleic acid molecules to include bulky modifications of a size of about 1 nm or less thereby preventing unwinding of the blocked nucleic acid molecules in the cascade reaction.

In some aspects of the aforementioned embodiments, the blocked nucleic acid molecules are blocked primer molecules.

In a further embodiment, there is provided a method for preventing unwinding of blocked nucleic acid molecules or blocked primer molecules in the presence of an RNP comprising the steps of: providing blocked nucleic acid molecules or blocked primer molecules; providing ribonucleoprotein complexes comprising a nucleic acid-guided nuclease that exhibits both cis- and trans-cleavage activity upon activation and a gRNA that recognizes an unblocked nucleic acid molecule or an unblocked primer molecule resulting from trans-cleavage of the blocked nucleic acid molecule or blocked primer molecule; and providing a molar concentration of blocked nucleic acid molecules that exceeds the molar concentration of ribonucleoprotein complexes; engineering the nucleic acid-guided nuclease used in the ribonucleoprotein complex to result in a variant nucleic acid-guided nuclease such that single stranded DNA is cleaved times faster than double stranded DNA is cleaved; and/or 3) engineering the blocked nucleic acid molecules to include bulky modifications of a size of about 1 nm or less.

Other embodiments provide a method for detecting target nucleic acid molecules in a sample in less than one minute without amplifying the target nucleic acid molecules; and instantaneously detecting target nucleic acid molecules in a sample without amplifying the target nucleic acid molecules.

In some aspects of the methods, the reaction mixture is provided at 16° C., and in some aspects, the reaction mixture is provided at 17° C., 18° C., 19° C., 20° C., 21° C., 22° C., 23° C., 24° C., 25° C., 26° C., 27° C., 28° C., 29° C., or 30° C. or higher.

Other embodiments provide reaction mixtures for identifying a target nucleic acid of interest in a sample in one minute or less comprising: first ribonucleoprotein (RNP1) complexes (RNP1s) each comprising a first nucleic acid-guided nuclease and a first gRNA, wherein the first gRNA comprises a sequence complementary to the target nucleic acid of interest; and wherein binding of the RNP1 complex to the target nucleic acid of interest activates cis-cleavage and trans-cleavage activity of the first nucleic acid-guided nuclease; second ribonucleoprotein complexes (RNP2s) comprising a second nucleic acid-guided nuclease and a second gRNA that is not complementary to the target nucleic acid of interest; wherein the second nucleic acid-guided nuclease optionally comprises a variant nuclease engineered such that single stranded DNA is cleaved faster than double stranded DNA is cleaved, wherein the variant nuclease comprises at least one mutation to the domains that interact with the PAM region or surrounding sequences on the blocked nucleic acid molecules, and wherein the variant nuclease exhibits both cis- and trans-cleavage activity; and a plurality of the blocked nucleic acid molecules comprising a sequence corresponding to the second gRNA, wherein the blocked nucleic acid molecules comprise: a first region recognized by the RNP2 complex; one or more second regions not complementary to the first region forming at least one loop; one or more third regions complementary to and hybridized to the first region forming at least one clamp, and wherein the blocked nucleic acid molecules optionally each comprise at least one bulky modification, wherein the plurality of blocked nucleic acid molecules and the RNP2s optionally are at a concentration ratio where blocked nucleic acid molecules are at a higher molar concentration than the RNP2s in the reaction mixture, and wherein the reaction mixture comprises at least one of a variant nuclease, a concentration ratio where blocked nucleic acid molecules are at a higher molar concentration than the RNP2s in the reaction mixture, and/or blocked nucleic acid molecules comprising at least one bulky modification.

Also provided is a reaction mixture for identifying a target nucleic acid of interest in a sample in one minute or less comprising: first ribonucleoprotein complexes (RNP1s), wherein the RNP1s comprise a first nucleic acid-guided nuclease and a first guide RNA (gRNA); wherein the first gRNA comprises a sequence complementary to the nucleic acid target of interest, and wherein the first nucleic acid-guided nuclease exhibits both cis-cleavage activity and trans-cleavage activity; second ribonucleoprotein complexes (RNP2s) comprising a second nucleic acid-guided nuclease and a second gRNA that is not complementary to the target nucleic acid of interest; wherein the second nucleic acid-guided nuclease optionally comprises a variant nuclease engineered such that single stranded DNA is cleaved faster than double stranded DNA is cleaved, wherein the variant nuclease comprises at least one mutation to the domains that interact with the PAM region or surrounding sequences on synthesized activating molecules, and wherein the variant nuclease exhibits both cis- and trans-cleavage activity; a plurality of template molecules comprising sequence homology to the second gRNA; a plurality of the blocked primer molecules comprising a sequence complementary to the template molecules, wherein the blocked primer molecules cannot be extended by a polymerase, and wherein the blocked primer molecules comprise: a first region recognized by the RNP2; one or more second regions not complementary to the first region forming at least one loop; and one or more third regions complementary to and hybridized to the first region forming at least one clamp, wherein the blocked primer molecules optionally each comprise at least one bulky modification and wherein the plurality of blocked primer molecules and the RNP2s optionally are at a concentration ratio where blocked nucleic acid molecules are at a higher molar concentration than the RNP2s in the reaction mixture, and wherein the reaction mixture comprises at least one of a variant nuclease, at a concentration ratio where blocked nucleic acid molecules are at a higher molar concentration than the RNP2s in the reaction mixture, and/or blocked nucleic acid molecules comprising at least one bulky modification; and a polymerase and a plurality of nucleotides.

Further provided is a composition of matter comprising: ribonucleoprotein complexes (RNPs) comprising a nucleic acid-guided nuclease and a gRNA that is not complementary to the target nucleic acid of interest; wherein the nucleic acid-guided nuclease optionally comprises a variant nuclease engineered such that single stranded DNA is cleaved faster than double stranded DNA is cleaved, wherein the variant nuclease comprises at least one mutation to the domains that interact with the PAM region or surrounding sequences on the blocked nucleic acid molecules, and wherein the variant nuclease exhibits both cis- and trans-cleavage activity; and a plurality of the blocked nucleic acid molecules comprising a sequence corresponding to the gRNA, wherein the blocked nucleic acid molecules comprise: a first region recognized by the RNP complex; one or more second regions not complementary to the first region forming at least one loop; one or more third regions complementary to and hybridized to the first region forming at least one clamp, wherein the blocked nucleic acid molecules each comprise at least one bulky modification, wherein the blocked nucleic acid molecules optionally each comprise at least one bulky modification, and wherein the plurality of blocked nucleic acid molecules and the RNP2s optionally are at a concentration ratio where the blocked nucleic acid molecules are at a higher molar concentration than the RNP2s in the reaction mixture, and wherein the composition comprises at least one of a variant nuclease, a concentration ratio where the blocked nucleic acid molecules are at a higher molar concentration than the RNP2s in the reaction mixture, and/or blocked nucleic acid molecules comprising at least one bulky modification; and a polymerase and a plurality of nucleotides.

Additionally provided is a composition of matter comprising: ribonucleoprotein complexes (RNPs) comprising a nucleic acid-guided nuclease and a gRNA that is not complementary to the target nucleic acid of interest; wherein the second nucleic acid-guided nuclease optionally comprises a variant nuclease engineered such that single stranded DNA is cleaved faster than double stranded DNA is cleaved, wherein the variant nuclease comprises at least one mutation to the domains that interact with the PAM region or surrounding sequences on the blocked nucleic acid molecules, and wherein the variant nuclease exhibits both cis- and trans-cleavage activity; a plurality of template molecules comprising sequence homology to the gRNA; and a plurality of the blocked primer molecules comprising a sequence complementary to the template molecules, wherein the blocked primer molecules cannot be extended by a polymerase, and wherein the blocked primer molecules comprise: a first region recognized by the RNP2; one or more second regions not complementary to the first region forming at least one loop; and one or more third regions complementary to and hybridized to the first region forming at least one clamp, wherein the blocked primer molecules optionally each comprise at least one bulky modification, and wherein the plurality of blocked primer molecules and the RNPs optionally are at a concentration where the blocked nucleic acid molecules are at a molar concentration equal to or greater than the molar concentration of the RNPs in the reaction mixture, and wherein the composition comprises at least one of a variant nuclease, a concentration ratio where blocked nucleic acid molecules are at a higher molar concentration than the RNP2s in the reaction mixture, and/or blocked nucleic acid molecules comprising at least one bulky modification; and a polymerase and a plurality of nucleotides.

In some aspects of these embodiments, the reaction mixture further comprises reporter moieties, wherein the reporter moieties produce a detectable signal upon trans-cleavage activity by the RNP2 to identify the presence of one or more nucleic acid targets of interest in the sample. In some aspects, the reporter moieties are not coupled to the blocked primer molecules, and wherein upon cleavage by RNP2, a signal from the reporter moiety is detected; yet in other aspects, the reporter moieties are coupled to the blocked primer molecules, and wherein upon cleavage by RNP2, a signal from the reporter moiety is detected.

In some aspects of all embodiments comprising bulky modifications, the bulky modifications are about 1 nm in size, and in some aspects, the bulky modifications are about 0.9 nm, 0.8 nm, 0.7 nm, 0.6 nm, 0.5 nm, 0.4 nm, 0.3 nm, 0.2 nm, or 0.1 nm in size. In some aspects, the bulky modifications are about 0.9 nm, 0.8 nm, 0.7 nm, 0.6 nm, 0.5 nm, 0.4 nm, 0.3 nm, 0.2 nm, or 0.1 nm in size. In some aspects, the blocked nucleic acid molecules include bulky modifications and wherein there are two bulky modifications with one bulky modification located on the 5' end of the blocked nucleic acid molecule and one bulky modification located on the 3' end of the blocked nucleic acid molecule, and where the 5' and 3' ends comprising the two bulky modifications are less than 11 nm from one another. In other aspects, the bulky modification is on a 5' end of blocked nucleic acid molecules and may be selected from the group of 5' Fam (6-fluorescein amidite); Black Hole Quencher-1-5'; biotin TEG (15 atom triethylene glycol spacer); biotin-5'; and cholesterol TEG (15 atom triethylene glycol spacer). In other aspects, the bulky modification is on a 3' end of the blocked nucleic acid molecules and may be selected from the group of Black Hole Quencher-1-3'; biotin-3'; and TAMRA-3' (carboxytetramethylrhodamine). In some aspects, a bulky modification is between two internal nucleic acid residues of the blocked nucleic acid molecules and may be selected from the group of Cy3 internal and Cy5, and in some aspects, the bulky modification is an internal nucleotide base modification and may be selected from the group of biotin deoxythymidine dT; disthiobiotin NHS; and fluorescein dT.

In some aspects of these embodiments, the blocked nucleic acid molecules or blocked primer molecules comprise a structure represented by any one of Formulas I-IV, wherein Formulas I-IV are in the 5'-to-3' direction:

(a)A-(B-L)J-C-M-T-D　　　　　(Formula I);

wherein A is 0-15 nucleotides in length;
B is 4-12 nucleotides in length;
L is 3-25 nucleotides in length;
J is an integer between 1 and 10;
C is 4-15 nucleotides in length;

M is 1-25 nucleotides in length or is absent, wherein if M is absent then A-(B-L)J-C and T-D are separate nucleic acid strands;
T is 17-135 nucleotides in length and comprises at least 50% sequence complementarity to B and C; and
D is 0-10 nucleotides in length and comprises at least 50% sequence complementarity to A;

(b)D-T-T'-C-(L-B)J-A　　　　　(Formula II);

wherein D is 0-10 nucleotides in length;
T-T' is 17-135 nucleotides in length;
T' is 1-10 nucleotides in length and does not hybridize with T;
C is 4-15 nucleotides in length and comprises at least 50% sequence complementarity to T;
L is 3-25 nucleotides in length and does not hybridize with T;
B is 4-12 nucleotides in length and comprises at least 50% sequence complementarity to T;
J is an integer between 1 and 10;
A is 0-15 nucleotides in length and comprises at least 50% sequence complementarity to D;

(c)T-D-M-A-(B-L)J-C　　　　　(Formula III);

wherein T is 17-135 nucleotides in length;
D is 0-10 nucleotides in length;
M is 1-25 nucleotides in length or is absent, wherein if M is absent then T-D and A-(B-L)J-C are separate nucleic acid strands;
A is 0-15 nucleotides in length and comprises at least 50% sequence complementarity to D;
B is 4-12 nucleotides in length and comprises at least 50% sequence complementarity to T;
L is 3-25 nucleotides in length;
J is an integer between 1 and 10; and
C is 4-15 nucleotides in length; or (d)T-D-M-A-$L_p$-C　　　　　(Formula IV);

wherein T is 17-31 nucleotides in length (e.g., 17-100, 17-50, or 17-25);
D is 0-15 nucleotides in length;
M is 1-25 nucleotides in length;
A is 0-15 nucleotides in length and comprises a sequence complementary to D; and
L is 3-25 nucleotides in length;
p is 0 or 1;
C is 4-15 nucleotides in length and comprises a sequence complementary to T.

In some aspects, (a) T of Formula I comprises at least 80% sequence complementarity to B and C; (b) D of Formula I comprises at least 80% sequence complementarity to A; (c) C of Formula II comprises at least 80% sequence complementarity to T; (d) B of Formula II comprises at least 80% sequence complementarity to T; (e) A of Formula II comprises at least 80% sequence complementarity to D; (f) A of Formula III comprises at least 80% sequence complementarity to D; (g) B of Formula III comprises at least 80% sequence complementarity to T; (h) A of Formula IV comprises at least 80% sequence complementarity to D; and/or (i) C of Formula IV comprises at least 80% sequence complementarity to T.

In some aspects, the variant nucleic acid-guided nuclease is a Type V variant nucleic acid-guided nuclease. In some aspects, the one or both of the RNP1 and the RNP2 comprise a nucleic acid-guided nuclease selected from Cas3, Cas12a, Cas12b, Cas12c, Cas12d, Cas12e, Cas14, Cas12h, Cas12i, Cas12j, Cas13a, or Cas13b.

In some aspects of the embodiments that comprise a variant nucleic acid-guided nuclease, the variant nucleic acid-guided nuclease comprises at least one mutation to the domains that interact with the PAM region or surrounding sequences on the blocked nucleic acid molecules wherein the mutation is selected from mutations to amino acid residues K538, Y542 and K595 in relation to SEQ ID NO:1 and equivalent amino acid residues in orthologs. In some embodiments, there are at least two mutations to the domains that interact with the PAM region or surrounding sequences on the blocked nucleic acid molecules selected from mutations to amino acid residues K538, Y542 and K595 in relation to SEQ ID NO:1 and equivalent amino acid residues in orthologs and in other aspects, there are at least three mutations to the domains that interact with the PAM region or surrounding sequences on the blocked nucleic acid molecules selected from mutations to amino acid residues K538, Y542 and K595 in relation to SEQ ID NO:1 and equivalent amino acid residues in orthologs. In some aspects, the variant nucleic acid-guided nuclease comprises at least one mutation to the domains that interact with the PAM region or surrounding sequences on the blocked nucleic acid molecules, wherein the at least one mutation is selected from mutations to amino acid residues K548, N552 and K607 in relation to SEQ ID NO:2; mutations to amino acid residues K534, Y538 and R591 in relation to SEQ ID NO:3; mutations to amino acid residues K541, N545 and K601 in relation to SEQ ID NO:4; mutations to amino acid residues K579, N583 and K635 in relation to SEQ ID NO:5; mutations to amino acid residues K613, N617 and K671 in relation to SEQ ID NO:6; mutations to amino acid residues K613, N617 and K671 in relation to SEQ ID NO:7; mutations to amino acid residues K617, N621 and K678 in relation to SEQ ID NO:8; mutations to amino acid residues K541, N545 and K601 in relation to SEQ ID NO:9; mutations to amino acid residues K569, N573 and K625 in relation to SEQ ID NO:10; mutations to amino acid residues K562, N566 and K619 in relation to SEQ ID NO:11; mutations to amino acid residues K645, N649 and K732 in relation to SEQ ID NO:12; mutations to amino acid residues K548, N552 and K607 in relation to SEQ ID NO:13; mutations to amino acid residues K592, N596 and K653 in relation to SEQ ID NO:14; or mutations to amino acid residues K521, N525 and K577 in relation to SEQ ID NO:15.

In some aspects, the variant nucleic acid-guided nuclease comprises at least one mutation to the domains that interact with the PAM region or surrounding sequences on the blocked nucleic acid molecules, wherein single stranded DNA is cleaved 1.2 to 2.5 times faster than double stranded DNA is cleaved, at least three to four times faster than double stranded DNA is cleaved, and in some aspects, single stranded DNA is cleaved at least five times faster than double stranded DNA is cleaved. In aspects, the variant nucleic acid-guided nuclease exhibits cis- and trans-cleavage activity.

In some aspects, the variant nucleic acid-guided nuclease comprises at least two mutations to the domains that interact with the PAM region or surrounding sequences on the blocked nucleic acid molecules, and in some aspects, the variant nuclease comprises at least three mutations to the domains that interact with the PAM region or surrounding sequences on the blocked nucleic acid molecules.

In any of the embodiments comprising a concentration ratio where blocked nucleic acid molecules are at a higher molar concentration than the RNP2s in the reaction mixture, certain aspects provide that the concentration of the blocked nucleic acid molecules and the RNP2s are at a concentration ratio of at least 1.5 blocked nucleic acid molecules to 1 RNP2 in the reaction mixture, and in some aspects, the concentration of the blocked nucleic acid molecules and the RNP2s are at a concentration ratio of at least 2 blocked nucleic acid molecules to 1 RNP2 in the reaction mixture or at least 3 blocked nucleic acid molecules to 1 RNP2, or at least 3.5 blocked nucleic acid molecules to 1 RNP2, or at least 4 blocked nucleic acid molecules to 1 RNP2, or at least 4.5 blocked nucleic acid molecules to 1 RNP2, or at least 5 blocked nucleic acid molecules to 1 RNP2, or at least 5.5 blocked nucleic acid molecules to 1 RNP2, or at least 6 blocked nucleic acid molecules to 1 RNP2, or at least 6.5 blocked nucleic acid molecules to 1 RNP2, or at least 7.5 blocked nucleic acid molecules to 1 RNP2, or at least 7.5 blocked nucleic acid molecules to 1 RNP2, or at least 8 blocked nucleic acid molecules to 1 RNP2, or at least 8.5 blocked nucleic acid molecules to 1 RNP2, or at least 9 blocked nucleic acid molecules to 1 RNP2, or at least 9.5 blocked nucleic acid molecules to 1 RNP2, or at least 10 blocked nucleic acid molecules to 1 RNP2.

In further embodiments there is provided a variant Cas12a nuclease engineered such that single stranded DNA is cleaved faster than double stranded DNA is cleaved, wherein the variant Cas12a nuclease comprises at least one mutation to the domains that interact with the PAM region or surrounding sequences on the blocked nucleic acid molecules and wherein the variant Cas12a nuclease exhibits both cis- and trans-cleavage activity. In some aspects, wherein the at least one mutation to the domains that interact with the PAM region or surrounding sequences on the blocked nucleic acid molecules is selected from mutations to amino acid residues K538, Y542 and K595 in relation to SEQ ID NO:1; the at least one mutation to the domains that interact with the PAM region or surrounding sequences on the blocked nucleic acid molecules is selected from mutations to amino acid residues K548, N552 and K607 in relation to SEQ ID NO:2; the at least one mutation to the domains that interact with the PAM region or surrounding sequences on the blocked nucleic acid molecules is selected from mutations to amino acid residues K534, Y538 and R591 in relation to SEQ ID NO:3; the at least one mutation to the domains that interact with the PAM region or surrounding sequences on the blocked nucleic acid molecules is selected from mutations to amino acid residues K541, N545 and K601 in relation to SEQ ID NO:4; the at least one mutation to the domains that interact with the PAM region or surrounding sequences on the blocked nucleic acid molecules is selected from mutations to amino acid residues K579, N583 and K635 in relation to SEQ ID NO:5; the at least one mutation to the domains that interact with the PAM region or surrounding sequences on the blocked nucleic acid molecules is selected from mutations to amino acid residues K613, N617 and K671 in relation to SEQ ID NO:6; the at least one mutation to the domains that interact with the PAM region or surrounding sequences on the blocked nucleic acid molecules is selected from mutations to amino acid residues K613, N617 and K671 in relation to SEQ ID NO:7; the at least one mutation to the domains that interact with the PAM region or surrounding sequences on the blocked nucleic acid molecules is selected from mutations to amino acid residues K617, N621 and K678 in relation to SEQ ID NO:8; the at least one mutation to the domains that interact with the PAM region or surrounding sequences on the blocked nucleic acid molecules is selected from mutations to amino acid residues K541, N545 and K601 in relation to SEQ ID NO:9; the at least one mutation to the domains that interact with the PAM region or surrounding sequences on the blocked nucleic acid molecules is selected from mutations to amino acid residues K569, N573 and K625 in relation to SEQ ID NO:10; the at least one mutation to the domains that interact with the PAM region or surrounding sequences on the blocked nucleic acid molecules is selected from mutations to amino acid residues K562, N566 and K619 in relation to SEQ ID NO:11; the at least one mutation to the domains that interact with the PAM region or surrounding sequences on the blocked nucleic acid molecules is selected from mutations to amino acid residues K645, N649 and K732 in relation to SEQ ID NO:12; the at least one mutation to the domains that interact with the PAM region or surrounding sequences on the blocked nucleic acid molecules is selected from mutations to amino acid residues K548, N552 and K607 in relation to SEQ ID NO:13; the at least one mutation to the domains that interact with the PAM region or surrounding sequences on the blocked nucleic acid molecules is selected from mutations to amino acid residues K592, N596 and K653 in relation to SEQ ID NO:14; or the at least one mutation to the domains that interact with the PAM region or surrounding sequences on the blocked nucleic acid molecules is selected from mutations to amino acid residues K521, N525 and K577 in relation to SEQ ID NO:15 including and equivalent amino acid residues in Cas12a orthologs to these SEQ ID Nos: 1-15.

In some aspects, the variant Cas12a nuclease that has been engineered such that single stranded DNA is cleaved faster than double stranded DNA is cleaved comprises any one of SEQ ID NOs: 16-600.

Alternatively, an embodiment provides a single-strand-specific Cas12a nucleic acid-guided nucleases comprising an LbCas12a (i.e., SEQ ID NO: 1) with an acetylated K595 ($K595K^{Ac}$) residue; an AsCas12a (i.e., SEQ ID NO: 2) with an acetylated K607 ($K607K^{Ac}$) residue; a CtCas12a (i.e., SEQ ID NO: 3) with an acetylated R591 ($R591R^{Ac}$) residue; an EeCas12a (i.e., SEQ ID NO: 4) with an acetylated K601 ($K607K^{Ac}$) residues; an Mb3Cas12a (i.e., SEQ ID NO: 5) with an acetylated K635 ($K635K^{Ac}$) residue; an FnCas12a (i.e., SEQ ID NO: 6) with an acetylated K671 ($K671K^{Ac}$) residue; an FnoCas12a (i.e., SEQ ID NO: 7) with an acetylated N671 ($N671K^{Ac}$) residue; an FbCas12a (i.e., SEQ ID NO: 8) with an acetylated K678 ($K678K^{Ac}$) residue; an Lb4Cas12a (i.e., SEQ ID NO: 9) with an acetylated K601 ($K601K^{Ac}$) residue; an MbCas12a (i.e., SEQ ID NO: 10) with an acetylated K625 ($K625K^{Ac}$) residue; a Pb2Cas12a (i.e., SEQ ID NO: 11) with an acetylated K619 ($K619K^{Ac}$) residue; a PgCas12a (i.e., SEQ ID NO: 12) with an acetylated K732 ($K732K^{Ac}$) residue; an AaCas12a (i.e., SEQ ID NO: 13) with an acetylated K607 ($K607K^{Ac}$) residue; a BoCas12a (i.e., SEQ ID NO: 14) with an acetylated K653 ($K653K^{Ac}$) residue; or an CmaCas12a (i.e., SEQ ID NO: 15) with an acetylated K577 ($K577K^{Ac}$) residue. The single-strand-specific Cas12a nucleic acid-guided nucleases of the disclosure may be a Cas12a ortholog acetylated at the amino acid of the ortholog equivalent to K595 of SEQ ID NO:1.

These aspects and other features and advantages of the invention are described below in more detail.

BRIEF DESCRIPTION OF THE DRAWINGS

The foregoing and other features and advantages of the present invention will be more fully understood from the following detailed description of illustrative embodiments taken in conjunction with the accompanying drawings in which:

FIG. 2E shows schematics of several exemplary blocked nucleic acid molecules containing the structure of Formula III, as described herein.

FIG. 2F shows schematics of several exemplary blocked nucleic acid molecules containing the structure of Formula IV, as described herein.

FIG. 7 is a simplified diagram of acetylating the K595 amino acid in the wildtype sequence of LbCas12a ($K595K^{Ac}$).

FIG. 8A is an illustration of a blocked nucleic acid molecule with bulky modifications, cleavage thereof, and steric hindrance at the PAM-interacting (PI) domain in a nucleic acid-guided nuclease caused by 5' and 3' modifications to a blocked nucleic acid molecule.

FIGS. 8C, 8D and 8E list exemplary bulky modifications for 5', 3', and internal positions in blocked nucleic acid molecules.

FIG. 9 is an illustration of a lateral flow assay that can be used to detect the cleavage and separation of a signal from a reporter moiety.

FIGS. 12A-12G are a series of graphs showing the time for detection of dsDNA and ssDNA both with and without PAM sequences for wildtype LbaCas12a and engineered variants of LbaCas12a.

It should be understood that the drawings are not necessarily to scale, and that like reference numbers refer to like features.

Definitions

Figure 1A:
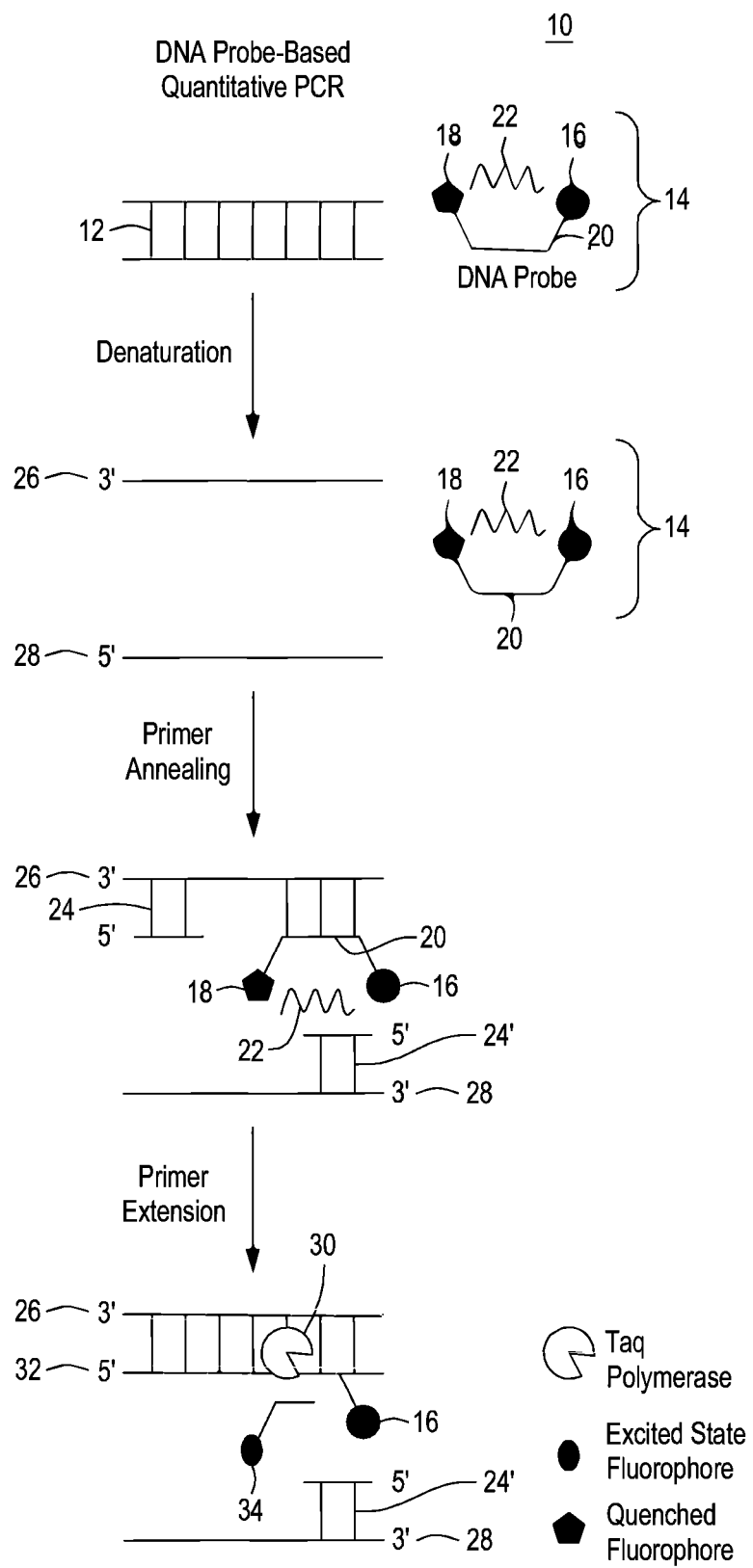
FIG. 1A is an overview of a prior art quantitative PCR ("qPCR") assay where target nucleic acids of interest from a sample are amplified before detection.

In the following description, numerous specific details are set forth to provide a more thorough understanding of the present invention. However, it will be apparent to one of skill in the art that the present invention may be practiced without one or more of these specific details. In other instances, features and procedures well known to those skilled in the art have not been described in order to avoid obscuring the invention. The terms used herein are intended to have the plain and ordinary meaning as understood by those of ordinary skill in the art.

All of the functionalities described in connection with one embodiment of the compositions and/or methods described herein are intended to be applicable to the additional embodiments of the compositions and/or methods except where expressly stated or where the feature or function is incompatible with the additional embodiments. For example, where a given feature or function is expressly described in connection with one embodiment but not expressly mentioned in connection with an alternative embodiment, it should be understood that the feature or function may be deployed, utilized, or implemented in connection with the alternative embodiment unless the feature or function is incompatible with the alternative embodiment.

Note that as used herein and in the appended claims, the singular forms "a," "an," and "the" include plural referents unless the context clearly dictates otherwise. Thus, for example, reference to "a cell" refers to one or more cells, and reference to "a system" includes reference to equivalent steps, methods and devices known to those skilled in the art, and so forth. Additionally, it is to be understood that terms such as "left," "right," "top," "bottom," "front," "rear," "side," "height," "length," "width," "upper," "lower," "interior," "exterior," "inner," "outer" that may be used herein merely describe points of reference and do not necessarily limit embodiments of the present disclosure to any particular orientation or configuration. Furthermore, terms such as "first," "second," "third," etc., merely identify one of a number of portions, components, steps, operations, functions, and/or points of reference as disclosed herein, and likewise do not necessarily limit embodiments of the present disclosure to any particular configuration or orientation.

Unless defined otherwise, all technical and scientific terms used herein have the same meaning as commonly understood by one of ordinary skill in the art to which this invention belongs. All publications mentioned herein are incorporated by reference for the purpose of describing and disclosing devices, formulations and methodologies that may be used in connection with the presently described invention. Conventional methods are used for the procedures described herein, such as those provided in the art, and demonstrated in the Examples and various general references. Unless otherwise stated, nucleic acid sequences described herein are given, when read from left to right, in the 5' to 3' direction. Nucleic acid sequences may be provided as DNA, as RNA, or a combination of DNA and RNA (e.g., a chimeric nucleic acid).

Where a range of values is provided, it is understood that each intervening value, between the upper and lower limit of that range and any other stated or intervening value in that stated range is encompassed within the invention. The upper and lower limits of these smaller ranges may independently be included in smaller ranges, and are also encompassed within the invention, subject to any specifically excluded limit in the stated range. Where the stated range includes one or both limits, ranges excluding either or both of those included limits are also included in the invention.

The term "and/or" where used herein is to be taken as specific disclosure of each of the multiple specified features or components with or without another. Thus, the term "and/or" as used in a phrase such as "A and/or B" herein is intended to include "A and B," "A or B," "A" (alone), and "B" (alone). Likewise, the term "and/or" as used in a phrase such as "A, B, and/or C" is intended to encompass each of the following embodiments: A, B, and C; A, B, or C; A or C; A or B; B or C; A and C; A and B; B and C; A (alone); B (alone); and C (alone).

As used herein, the term "about," as applied to one or more values of interest, refers to a value that falls within 10%, 9%, 8%, 7%, 6%, 5%, 4%, 3%, 2%, 1%, or less in either direction (greater than or less than) of a stated reference value, unless otherwise stated or otherwise evident from the context (except where such number would exceed 100% of a possible value).

As used herein, the terms "binding affinity" or "dissociation constant" or "$K_d$" refer to the tendency of a molecule to bind (covalently or non-covalently) to a different molecule. A high $K_d$ (which in the context of the present disclosure refers to blocked nucleic acid molecules or blocked primer molecules binding to RNP2) indicates the presence of more unbound molecules, and a low $K_d$ (which in the context of the present disclosure refers to unblocked nucleic acid molecules or unblocked primer molecules binding to RNP2) indicates the presence of more bound molecules. In the context of the present disclosure and the binding of blocked or unblocked nucleic acid molecules or blocked or unblocked primer molecules to RNP2, low $K_d$ values are in a range from about 100 fM to about 1 aM or lower (e.g., 100 zM) and high $K_d$ values are in the range of 100 nM-100 µM (10 mM) and thus are about $10^5$- to $10^{10}$-fold or higher as compared to low $K_d$ values.

As used herein, the terms "binding domain" or "binding site" refer to a region on a protein, DNA, or RNA, to which specific molecules and/or ions (ligands) may form a covalent or non-covalent bond. By way of example, a polynucleotide sequence present on a nucleic acid molecule (e.g., a primer binding domain) may serve as a binding domain for a different nucleic acid molecule (e.g., an unblocked primer nucleic acid molecule). Characteristics of binding sites are chemical specificity, a measure of the types of ligands that will bond, and affinity, which is a measure of the strength of the chemical bond.

As used herein, the term "blocked nucleic acid molecule" refers to nucleic acid molecules that cannot bind to the first or second RNP complex to activate cis- or trans-cleavage. "Unblocked nucleic acid molecule" refers to a formerly blocked nucleic acid molecule that can bind to the second RNP complex (RNP2) to activate trans-cleavage of additional blocked nucleic acid molecules. A "blocked nucleic acid molecule" may be a "blocked primer molecule" in some embodiments of the cascade assay.

The terms "Cas RNA-guided nucleic acid-guided nuclease" or "CRISPR nuclease" or "nucleic acid-guided nuclease" refer to a CRISPR-associated protein that is an RNA-guided nucleic acid-guided nuclease suitable for assembly with a sequence-specific gRNA to form a ribonucleoprotein (RNP) complex.

As used herein, the terms "cis-cleavage", "cis-nucleic acid-guided nuclease activity", "cis-mediated nucleic acid-guided nuclease activity", "cis-nuclease activity", "cis-mediated nuclease activity", and variations thereof refer to sequence-specific cleavage of a target nucleic acid of interest, including an unblocked nucleic acid molecule or synthesized activating molecule, by a nucleic acid-guided nuclease in an RNP complex. Cis-cleavage is a single turn-over cleavage event in that only one substrate molecule is cleaved per event.

The term "complementary" as used herein refers to Watson-Crick base pairing between nucleotides and specifically refers to nucleotides hydrogen-bonded to one another with thymine or uracil residues linked to adenine residues by two hydrogen bonds and cytosine and guanine residues linked by three hydrogen bonds. In general, a nucleic acid includes a nucleotide sequence described as having a "percent complementarity" or "percent homology" to a specified second nucleotide sequence. For example, a nucleotide sequence may have 80%, 90%, or 100% complementarity to a specified second nucleotide sequence, indicating that 8 of 10, 9 of 10, or 10 of 10 nucleotides of a sequence are complementary to the specified second nucleotide sequence. For instance, the nucleotide sequence 3'-TCGA-5' is 100% complementary to the nucleotide sequence 5'-AGCT-3'; and the nucleotide sequence 3'-ATCGAT-5' is 100% complementary to a region of the nucleotide sequence 5'-GCTAGCTAG-3'.

As used herein, the term "contacting" refers to placement of two moieties in direct physical association, including in solid or liquid form. Contacting can occur in vitro with isolated cells (for example in a tissue culture dish or other vessel) or in samples or in vivo by administering an agent to a subject.

The term "conservative amino acid substitution" refers to the interchangeability in proteins of amino acid residues having similar side chains. For example, a group of amino acids having aliphatic side chains comprises glycine, alanine, valine, leucine, and isoleucine; a group of amino acids having aliphatic-hydroxyl side chains comprises serine and threonine; a group of amino acids having amide containing side chains comprises asparagine and glutamine; a group of amino acids having aromatic side chains comprises phenylalanine, tyrosine, and tryptophan; a group of amino acids having basic side chains comprises lysine, arginine, and histidine; a group of amino acids having acidic side chains comprises glutamate and aspartate; and a group of amino acids having sulfur containing side chains comprises cysteine and methionine. Exemplary conservative amino acid substitution groups are: valine-leucine-isoleucine, phenylalanine-tyrosine, lysine-arginine, alanine-valine-glycine, and asparagine-glutamine.

A "control" is a reference standard of a known value or range of values.

The terms "guide nucleic acid" or "guide RNA" or "gRNA" refer to a polynucleotide comprising 1) a crRNA region or guide sequence capable of hybridizing to the target strand of a target nucleic acid of interest, and 2) a scaffold sequence capable of interacting or complexing with a nucleic acid-guided nuclease. The crRNA region of the gRNA is a customizable component that enables specificity in every nucleic acid-guided nuclease reaction. A gRNA can include any polynucleotide sequence having sufficient complementarity with a target nucleic acid of interest to hybridize with the target nucleic acid of interest and to direct sequence-specific binding of a ribonucleoprotein (RNP) complex containing the gRNA and nucleic acid-guided nuclease to the target nucleic acid. Target nucleic acids of interest may include a protospacer adjacent motif (PAM), and, following gRNA binding, the nucleic acid-guided nuclease induces a double-stranded break either inside or outside the protospacer region on the target nucleic acid of interest, including on an unblocked nucleic acid molecule or synthesized activating molecule. A gRNA may contain a spacer sequence including a plurality of bases complementary to a protospacer sequence in the target nucleic acid. For example, a spacer can contain about 2, 3, 4, 5, 6, 7, 8, 9, 10, 11, 12, 13, 14, 15, 20, 25, 30, 35, 40, 45, 50, 55, 60, or more bases. The gRNA spacer may be 50%, 60%, 75%, 80%, 85%, 90%, 95%, 97.5%, 98%, 99%, or more complementary to its corresponding target nucleic acid of interest. Optimal alignment may be determined with the use of any suitable algorithm for aligning sequences. A guide RNA may be from about 20 nucleotides to about 300 nucleotides long. Guide RNAs may be produced synthetically or generated from a DNA template.

"Modified" refers to a changed state or structure of a molecule. Molecules may be modified in many ways including chemically, structurally, and functionally. In one embodiment, a nucleic acid molecule (for example, a blocked nucleic acid molecule) may be modified by the introduction of non-natural nucleosides, nucleotides, and/or internucleoside linkages. In another embodiment, a modified protein (e.g., a modified or variant nucleic acid-guided nuclease) may refer to any polypeptide sequence alteration which is different from the wildtype.

The terms "percent sequence identity", "percent identity", or "sequence identity" refer to percent (%) sequence identity with respect to a reference polynucleotide or polypeptide sequence following alignment by standard techniques. Alignment for purposes of determining percent sequence identity can be achieved in various ways that are within the capabilities of one of skill in the art, for example, using publicly available computer software such as BLAST, BLAST-2, PSI-BLAST, or Megalign software. In some embodiments, the software is MUSCLE (Edgar, Nucleic Acids Res., 32(5):1792-1797 (2004)). Those skilled in the art can determine appropriate parameters for aligning sequences, including any algorithms needed to achieve maximal alignment over the full length of the sequences being compared. For example, in embodiments, percent sequence identity values are generated using the sequence comparison computer program BLAST (Altschul, et al., J. Mol. Biol., 215:403-410 (1990)).

As used herein, the terms "preassembled ribonucleoprotein complex", "ribonucleoprotein complex", "RNP complex", or "RNP" refer to a complex containing a guide RNA (gRNA) and a nucleic acid-guided nuclease, where the gRNA is integrated with the nucleic acid-guided nuclease. The gRNA, which includes a sequence complementary to a target nucleic acid of interest, guides the RNP to the target nucleic acid of interest and hybridizes to it. The hybridized target nucleic acid-gRNA units are cleaved by the nucleic acid-guided nuclease. In the cascade assays described herein, a first ribonucleoprotein complex (RNP1) includes a first guide RNA (gRNA) specific to a target nucleic acid of interest, and a first nucleic acid-guided nuclease, such as, for example, cas12a or cas14a for a DNA target nucleic acid, or cas13a for an RNA target nucleic acid. A second ribonucleoprotein complex (RNP2) for signal amplification includes a second guide RNA specific to an unblocked nucleic acid or synthesized activating molecule, and a second nucleic acid-guided nuclease, which may be different from or the same as the first nucleic acid-guided nuclease.

As used herein, the terms "protein" and "polypeptide" are used interchangeably. Proteins may or may not be made up entirely of amino acids.

As used herein, the term "sample" refers to tissues; cells or component parts; body fluids, including but not limited to peripheral blood, serum, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, and umbilical cord blood. "Sample" may also refer to specimens or aliquots from food; agricultural products; pharmaceuticals; cosmetics, nutraceuticals; personal care products; environmental substances such as soil, water (from both natural and treatment sites), air, or sewer samples; industrial sites and products; and chemicals and compounds. A sample further may include a homogenate, lysate or extract. A sample further refers to a medium, such as a nutrient broth or gel, which may contain cellular components, such as proteins or nucleic acid molecules.

The terms "target DNA sequence", "target sequence", "target nucleic acid of interest", "target molecule of interest", "target nucleic acid", or "target of interest" refer to any locus that is recognized by a gRNA sequence in vitro or in vivo. The "target strand" of a target nucleic acid of interest is the strand of the double-stranded target nucleic acid that is complementary to a gRNA. The spacer sequence of a gRNA may be 50%, 60%, 75%, 80%, 85%, 90%, 95%, 97.5%, 98%, 99% or more complementary to the target nucleic acid of interest. Optimal alignment can be determined with the use of any suitable algorithm for aligning sequences. Full complementarity is not necessarily required provided there is sufficient complementarity to cause hybridization and trans-cleavage activation of an RNP complex. A target nucleic acid of interest can include any polynucleotide, such as DNA (ssDNA or dsDNA) or RNA polynucleotides. A target nucleic acid of interest may be located in the nucleus or cytoplasm of a cell such as, for example, within an organelle of a eukaryotic cell, such as a mitochondrion or a chloroplast, or it can be exogenous to a host cell, such as a eukaryotic cell or a prokaryotic cell. The target nucleic acid of interest may be present in a sample, such as a biological or environmental sample, and it can be a viral nucleic acid molecule, a bacterial nucleic acid molecule, a fungal nucleic acid molecule, or a polynucleotide of another organism, such as a coding or a non-coding sequence, and it may include single-stranded or double-stranded DNA molecules, such as a cDNA or genomic DNA, or RNA molecules, such as mRNA, tRNA, and rRNA. The target nucleic acid of interest may be associated with a protospacer adjacent motif (PAM) sequence, which may include a 2-5 base pair sequence adjacent to the protospacer. In some embodiments 1, 2, 3, 4, 5, 6, 7, 8, 9, 10, or more target nucleic acids can be detected by the disclosed method.

As used herein, the terms "trans-cleavage", "trans-nucleic acid-guided nuclease activity", "trans-mediated nucleic acid-guided nuclease activity", "trans-nuclease activity", "trans-mediated nuclease activity" and variations thereof refer to indiscriminate, non-sequence-specific cleavage of a target nucleic acid molecule by a nucleic acid-guided nuclease (such as by a Cas12, Cas13, and Cas14) which is triggered by binding of N nucleotides of a target nucleic acid molecule to a gRNA and/or by cis- (sequence-specific) cleavage of a target nucleic acid molecule. Trans-cleavage is a "multiple turn-over" event, in that more than one substrate molecule is cleaved after initiation by a single turn-over cis-cleavage event.

Type V CRISPR/Cas nucleic acid-guided nucleases are a subtype of Class 2 CRISPR/Cas effector nucleases such as, but not limited to, engineered Cas12a, Cas12b, Cas12c, C2c4, C2c8, C2c5, C2c10, C2c9, CasX (Cas12e), CasY (Cas12d), Cas 13a nucleases or naturally-occurring proteins, such as a Cas12a isolated from, for example, *Francisella tularensis* subsp. *novicida* (Gene ID: 60806594), Candidatus Methanoplasma *termitum* (Gene ID: 24818655), Candidatus Methanomethylophilus alvus (Gene ID: 15139718), and [*Eubacterium*] eligens ATCC 27750 (Gene ID: 41356122), and an artificial polypeptide, such as a chimeric protein.

The term "variant" in the context of the present disclosure refers to a polypeptide or polynucleotide that differs from a reference polypeptide or polynucleotide but retains essential properties. A typical variant of a polypeptide differs in amino acid sequence from another reference polypeptide. Generally, differences are limited so that the sequences of the reference polypeptide and the variant are closely similar overall and, in many if not most regions, identical. A variant and reference polypeptide may differ in one or more amino acid residues (e.g., substitutions, additions, and/or deletions). A variant of a polypeptide may be a conservatively modified variant. A substituted or inserted amino acid residue may or may not be one encoded by the genetic code (e.g., a non-natural amino acid). A variant of a polypeptide may be naturally occurring, such as an allelic variant, or it may be a variant that is not known to occur naturally. Variants include modifications—including chemical modifications—to one or more amino acids that do not involve amino acid substitutions, additions or deletions.

As used herein, the terms "variant engineered nucleic acid-guided nuclease" or "variant nucleic acid-guided nuclease" refer to nucleic acid-guided nucleases have been engineered to mutate the PAM interacting domains in the LbCas12a (Lachnospiraceae bacterium Cas12a), AsCas 12a (Acidaminococcus sp. BV3L6 Cas12a), CtCas12a (Candidatus Methanoplasma *termitum* Cas12a), EeCas12a (*Eubacterium* eligens Cas12a), Mb3Cas12a (*Moraxella* bovoculi Cas12a), FnCas12a (*Francisella novicida* Cas12a), FnoCas12a (*Francisella tularensis* subsp. *novicida* FTG Cas12a), FbCas12a (Flavobacteriales bacterium Cas12a), Lb4Cas12a (Lachnospira eligens Cas12a), MbCas12a (*Moraxella* bovoculi Cas12a), Pb2Cas12a (*Prevotella bryantii* Cas12a), PgCas12a (Candidatus Parcubacteria bacterium Cas12a), AaCas12a (Acidaminococcus sp. Cas12a), BoCas12a (Bacteroidetes bacterium Cas12a), CMaCas12a (Candidatus Methanomethylophilus alvus Mx1201 Cas12a), and to-be-discovered equivalent Cas12a nucleic acid-guided nucleases such that double-stranded DNA (dsDNA) substrates bind to the variant nucleic acid-guided nuclease and are cleaved by the variant nucleic acid-guided nuclease at a slower rate than single-stranded DNA (ssDNA) substrates.

A "vector" is any of a variety of nucleic acids that comprise a desired sequence or sequences to be delivered to and/or expressed in a cell. Vectors are typically composed of DNA, although RNA vectors are also available. Vectors include, but are not limited to, plasmids, fosmids, phagemids, virus genomes, synthetic chromosomes, and the like.

DETAILED DESCRIPTION

The present disclosure provides compositions of matter and methods for cascade assays that detect nucleic acids. The cascade assays allow for massive multiplexing, and provide high accuracy, low cost, minimum workflow and results in less than one minute or, in some embodiments, virtually instantaneously, even at ambient temperatures of about 16-20° C. or less up to 48° C. The cascade assays described herein comprise first and second ribonucleoprotein complexes and either blocked nucleic acid molecules or blocked primer molecules. The blocked nucleic acid molecules or blocked primer molecules keep the second ribonucleoprotein complexes "locked" unless and until a target nucleic acid of interest activates the first ribonucleoprotein complex. The methods comprise the steps of providing cascade assay components, contacting the cascade assay components with a sample, and detecting a signal that is generated only when a target nucleic acid of interest is present in the sample.

Early and accurate identification of, e.g., infectious agents, microbe contamination, variant nucleic acid sequences that indicate the presence of diseases such as cancer or contamination by heterologous sources is important in order to select correct treatment; identify tainted food, pharmaceuticals, cosmetics and other commercial goods; and to monitor the environment. Nucleic acid-guided nucleases, such as Type V nucleic acid-guided nucleases, can be utilized for the detection of target nucleic acids of interest associated with diseases, food contamination and environmental threats. However, currently available nucleic acid detection such as quantitative PCR (also known as real time PCR or qPCR) or CRISPR-based detection assays such as SHERLOCK™ and DETECTR™ rely on DNA amplification, which requires time and may lead to changes to the relative proportion of nucleic acids, particularly in multiplexed nucleic acid assays. The lack of rapidity for these detection assays is due to the fact that there is a significant lag phase early in the amplification process where fluorescence above background cannot be detected. With qPCR, for example, there is a lag until the cycle threshold or Ct value, which is the number of amplification cycles required for the fluorescent signal to exceed the background level of fluorescence, is achieved and can be quantified.

The present disclosure describes a signal boost cascade assay and improvements thereto that can detect one or more target nucleic acids of interest (e.g., DNA, RNA and/or cDNA) at attamolar (aM) (or lower) limits in less than one minute and in some embodiments virtually instantaneously without the need for amplifying the target nucleic acid(s) of interest, thereby avoiding the drawbacks of multiplex amplification, such as primer-dimerization. As described in detail below, the cascade assays utilize signal boost mechanisms comprising various components including nucleic acid-guided nucleases, guide RNAs (gRNAs) incorporated into ribonucleoprotein complexes (RNP complexes), blocked nucleic acid molecules or blocked primer molecules, reporter moieties, and, in some embodiments, polymerases and template molecules. A particularly advantageous feature of the cascade assay is that, with the exception of the gRNA in RNP1 (i.e., gRNA1), the cascade assay components are essentially identical no matter what target nucleic acid(s) of interest are being detected, and gRNA1 is easily programmable.

The improvements to the signal amplification or signal boost cascade assay described herein result from preventing undesired unwinding of the blocked nucleic acid molecules in the reaction mix by the second ribonucleoprotein complex (RNP2) before the blocked nucleic acid molecules are unblocked via trans-cleavage, leading to increased efficiency, reduced background, and increased signal-to-noise ratio in the cascade assay. Minimizing undesired unwinding serves two purposes. First, preventing undesired unwinding that happens not as a result of unblocking due to trans-cleavage subsequent to cis-cleavage of the target nucleic acid of interest or trans-cleavage of unblocked nucleic acid molecules—but due to other factors—leads to a "leaky" cascade assay system, which in turn leads to non-specific signal generation.

Second, preventing undesired unwinding limits non-specific interactions between the nucleic acid-guided nucleases (here, in the RNP2s) and blocked nucleic acid molecules such that only blocked nucleic acid molecules that become unblocked due to trans-cleavage activity react with the nucleic acid-guided nucleases. This "fidelity" in the cascade assay leads primarily to desired interactions and limits "wasteful" interactions where the nucleic acid-guided nucleases are essentially acting on blocked nucleic acid molecules rather than unblocked nucleic acid molecules. That is, the nucleic acid-guided nucleases are focused on desired interactions which then leads to immediate signal amplification or boost in the cascade assay.

The present disclosure provides three modalities to minimize leakiness leading to minimal false positives or higher background signal. The present disclosure demonstrates that undesired unwinding of the blocked nucleic acid molecules can be lessened substantially by 1) increasing the molar ratio of the concentration of blocked nucleic acid molecules (equivalent to a target nucleic acid molecule for the RNP2) to be equal to or greater than the molar concentration of RNP2 (e.g., the nucleic acid-guided nuclease in RNP2); 2) engineering the nucleic acid-guided nuclease used in RNP2 so as to increase the time it takes the nucleic acid-guided nuclease to recognize double-strand DNA at least two-fold and preferably three-fold or more; and/or 3) engineering the blocked nucleic acid molecules to include bulky modifications (that is, molecules with a size of about 1 nm or less).

The first modality for minimizing undesired unwinding of the blocked nucleic acid molecules (or blocked primer molecules) is to adjust the relative concentrations of the blocked nucleic acid molecules (or blocked primer molecules) and RNP2s such that the molar concentration of the blocked nucleic acid molecules (or blocked primer molecules) is equal to or greater than the molar concentration of RNP2s. Before the present disclosure, the common wisdom in performing CRISPR detection assays was to use a vast excess of nucleic acid-guided nuclease (e.g., RNP complex) to target.

In most detection assays, the quantity of the target nucleic acid of interest is not known (e.g., the detection assay is performed on a sample with an unknown concentration of target); however, in experiments conducted to determine the level of detection of two CRISPR detection assays known in the art, DETECTR™ and SHERLOCK™, the nucleic acid nuclease was present at ng/μL concentrations and the target of interest was present at very low copy numbers or at femtomolar to attamolar concentration. Thus, the present methods and reagent mixtures not only adjust the relative concentrations of the blocked nucleic acid molecules (or blocked primer molecules) and RNP2s such that the molar concentration of the blocked nucleic acid molecules (or blocked primer molecules) is equal to or greater than the molar concentration of RNP2s, but the molar concentration of RNP2s may still exceed the molar concentration of the blocked nucleic acid molecules by a lesser amount, such as where the molar concentration of RNP2s exceeds the molar concentration of blocked nucleic acid molecules (or blocked target molecules) by 100,000×, 50,000×, 25,000×, 10,000×, 5,000×, 1,000×, 500×, 100×, 50×, or 10× or less.

For example, Sun, et al. ran side-by-side comparisons of the DETECTR™ and SHERLOCK™ detection assays, using a concentration of 100 ng/μL LbCas12a in the DETECTR™ assay and a concentration of 20 ng/μL LwCas13a in the SHERLOCK™ assay, where the concentration of the target nucleic acid molecules ranged from 0 copies/μL, 0.1 copies/μL, 0.2 copies/μL, 1.0 copy/μL, 2.0 copies/μL, 5.0 copies/μL, 10.0 copies/μL, and so on up to 200.0 copies/μL. (Sun, et al., J. of Translational Medicine, 12:74 (2021).) In addition, Broughton, et al., ran the DETECTR™ assay using a concentration range of 2.5 copies/μL to 1250 copies/μL target nucleic acid molecules to 40 nM LbCas12 (see, Broughton, et al., Nat. Biotech., 38:870-74 (2020)); and Lee, et al., ran the SHERLOCK™ assay using a concentration range of 10 fM to 50 aM target nucleic acid molecules to 150 nM Cas12 (see Lee, et al., PNAS, 117(41):25722-31 (2020). Thus, the ratio of nucleic acid-guided nuclease to blocked nucleic acid molecule (e.g., target for RNP2) described herein is very different from ratios practiced in the art and this ratio has been determined to limit undesired unwinding of the blocked nucleic acid molecules (or blocked primer molecules).

In a second modality, variant nucleic acid-guided nucleases have been engineered to mutate the domains in the variants that interact with the PAM region or surrounding sequences on the blocked nucleic acid molecules in, e.g., Type V nucleic acid-guided nucleases such as the LbCas12a (Lachnospriaceae bacterium Cas12a), AsCas 12a (Acidaminococcus sp. BV3L6 Cas12a), CtCas12a (Candidatus Methanoplasma *termitum* Cas12a), EeCas12a (*Eubacterium eligens* Cas12a), Mb3Cas12a (*Moraxella* bovoculi Cas12a), FnCas12a (*Francisella novicida* Cas12a), FnoCas12a (*Francisella tularensis* subsp. *novicida* FTG Cas12a), FbCas12a (Flavobacteriales bacterium Cas12a), Lb4Cas12a (Lachnospira eligens Cas12a), MbCas12a (*Moraxella bovoculi* Cas12a), Pb2Cas12a (*Prevotella bryantii* Cas12a), PgCas12a (Candidatus Parcubacteria bacterium Cas12a), AaCas12a (Acidaminococcus sp. Cas12a), BoCas12a (Bacteroidetes bacterium Cas12a), CMaCas12a (Candidatus Methanomethylophilus alvus Mx1201 Cas12a), and other related nucleic acid-guided nucleases (e.g., homologs and orthologs of these nucleic acid-guided nucleases) also limit unwinding. These variant nucleic acid-guided nucleases have been engineered such that double-stranded DNA (dsDNA) substrates bind to and activate to the variant nucleic acid-guided nucleases slowly, but single-stranded DNA (ssDNA) substrates continue to bind and activate the variant nucleic acid-guided nuclease at a high rate. Thus, the variant nucleic acid-guided nucleases effect a "lock" on the RNP complex (here, the RNP2) vis-à-vis double-strand DNA. Locking RNP2 in this way lessens the likelihood of undesired unwinding of the blocked nucleic acid molecules as described in detail herein (see FIG. 1C and the accompanying discussion). Modifying the nucleic acid-guided nucleases to not recognize dsDNA or to recognize dsDNA is contrary to what is desired in other CRISPR-based diagnostic/detection assays.

Finally, another modality for minimizing undesired unwinding of the blocked nucleic acid molecules is to use "bulky modifications" at the 5' and/or 3' ends of the blocked nucleic acid molecules and/or at internal nucleic acid bases of the blocked nucleic acid molecules. Doing so creates steric hindrance at the domains of the nucleic acid-guided nuclease in RNP2 that interact with the PAM region or that interact with surrounding sequences on the blocked nucleic acid molecules, disrupting, e.g., PAM recognition in the target strand and preventing displacement of the non-target strand. Using bulky modifications is yet another path to locking RNP2 to double-strand DNA molecules thereby lessening the likelihood of undesired unwinding of the blocked nucleic acid molecules as described in detail herein (again, see FIG. 1C and the accompanying discussion). "Bulky modifications" include molecules with a size of about 1 nm or less.

FIG. 1A provides a simplified diagram demonstrating a prior art method for quantifying target nucleic acids of interest in a sample; namely, the quantitative polymerase chain reaction or qPCR, which to date may be considered the gold standard for quantitative detection assays. The difference between PCR and qPCR is that PCR is a qualitative technique that indicates the presence or absence of a target nucleic acid of interest in a sample, where qPCR allows for quantification of target nucleic acids of interest in a sample. qPCR involves selective amplification and quantitative detection of specific regions of DNA or cDNA (i.e., the target nucleic acid of interest) using oligonucleotide primers that flank the specific region(s) in the target nucleic acid(s) of interest. The primers are used to amplify the specific regions using a polymerase. Like PCR, repeated cycling of the amplification process leads to an exponential increase in the number of copies of the region(s) of interest; however, unlike traditional PCR, the increase is tracked using an intercalating dye or, as shown in FIG. 1A, a sequence-specific probe (e.g., a "Taq-man probe") the fluorescence of which is detected in real time. RT-qPCR differs from qPCR in that a reverse transcriptase is used to first copy RNA molecules to produce cDNA before the qPCR process commences.

FIG. 1A is an overview of a qPCR assay where target nucleic acids of interest from a sample are amplified before detection. FIG. 1A shows the qPCR method 10, comprising a double-stranded DNA template 12 and a sequence specific Taq-man probe 14 comprising a region complementary to the target nucleic acid of interest 20, a quencher 16, a quenched fluorophore 18 where 22 denotes quenching between the quencher 16 and quenched fluorophore 18. Upon denaturation, the two strands of the double-stranded DNA template 12 separate into complementary single strands 26 and 28. In the next step, primers 24 and 24' anneal to complementary single strands 26 and 28, as does the sequence-specific Taq-man probe 14 via the region complementary 20 to the complementary strand 26 of the target nucleic acid of interest. Initially the Taq-man probe is annealed to complementary strand 26 of the target region of interest intact; however, primers 24 and 24' are extended by polymerase 30 but the Taq-man probe is not, due to the absence of a 3' hydroxy group. Instead, the exonuclease activity of the polymerase "chews up" the Taq-man probe, thereby separating the quencher 16 from the quenched fluorophore 18 resulting in an unquenched or excited-state fluorophore 34. The fluorescence quenching ensures that fluorescence occurs only when target nucleic acids of interest are present and being copied, where the fluorescent signal is proportional to the number of single-strand target nucleic acids being amplified.

As noted above, the downside to the prior art, currently available detection assays such as qPCR, as well as CRISPR-based reaction assays such as SHERLOCK™ and DETECTR™ is that these assays rely on DNA amplification, which, in addition to issues with multiplexing, significantly hinders the ability to perform rapid testing, e.g., in the field. That is, where the present cascade assay works at ambient temperatures, including room temperatures and below, assays that require amplification of the target nucleic acids of interest do not work well at lower temperatures—even those assays utilizing isothermal amplification—due to non-specific binding of the primers and low polymerase activity. Further, primer design is far more challenging. As for the lack of rapidity of detection assays that require amplification of the target nucleic acids of interest, a significant lag phase occurs early in the amplification process where fluorescence above background cannot be detected, particularly in samples with very low copy numbers of the target nucleic acid of interest. And, again, amplification, particularly multiplex amplification, may cause changes to the relative proportion of nucleic acids in samples that, in turn, lead to artifacts or inaccurate results.

Figure 1B:
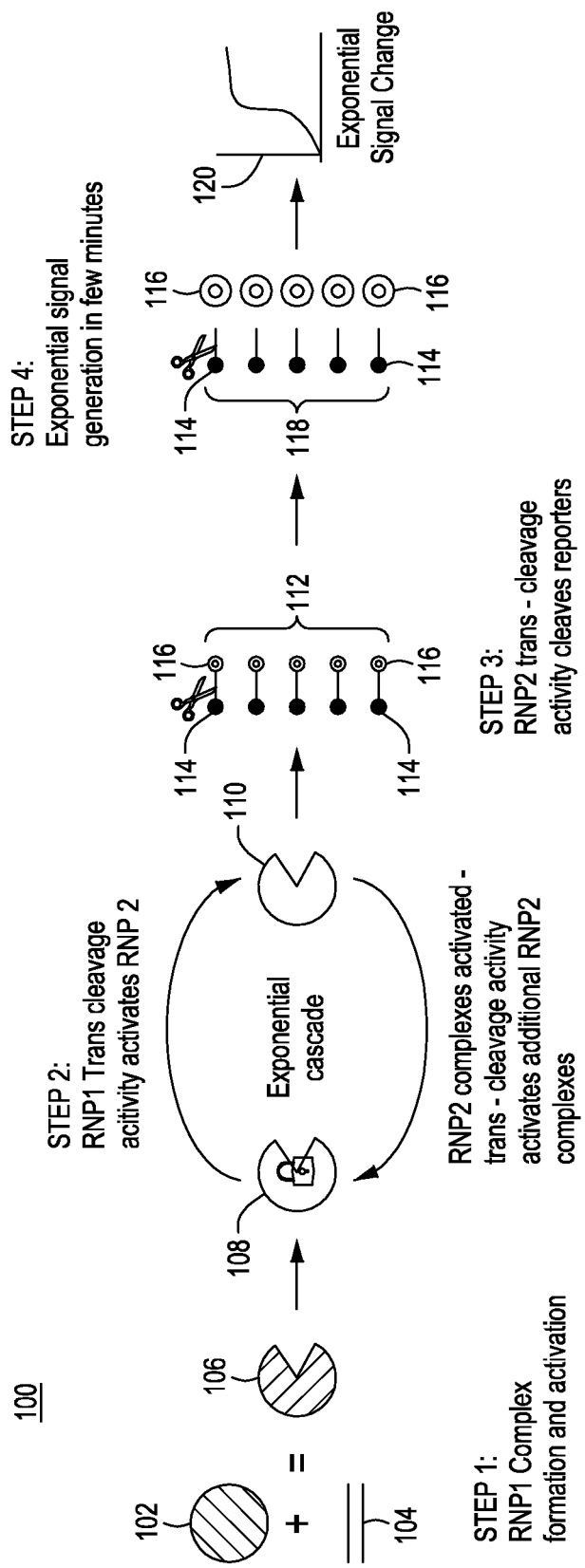
FIG. 1B is an overview of the general principles underlying the nucleic acid-guided nuclease cascade assay described in detail herein where target nucleic acids of interest from a sample do not need to be amplified before detection.

FIG. 1B provides a simplified diagram demonstrating a method (100) of a cascade assay. The cascade assay is initiated when the target nucleic acid of interest (104) binds to and activates a first pre-assembled ribonucleoprotein complex (RNP1) (102). A ribonucleoprotein complex comprises a guide RNA (gRNA) and a nucleic acid-guided nuclease, where the gRNA is integrated with the nucleic acid-guided nuclease. The gRNA, which includes a sequence complementary to the target nucleic acid of interest, guides an RNP complex to the target nucleic acid of interest and hybridizes to it. Typically, preassembled RNP complexes are employed in the reaction mix—as opposed to separate nucleic acid-guided nucleases and gRNAs—to facilitate rapid (and in the present cascade assays, virtually instantaneous) detection of the target nucleic acid(s) of interest.

"Activation" of RNP1 refers to activating trans-cleavage activity of the nucleic acid-guided nuclease in RNP1 (106) by binding of the target nucleic acid-guided nuclease to the gRNA of RNP1, initiating cis-cleavage where the target nucleic acid of interest is cleaved by the nucleic acid-guided nuclease. This binding and/or cis-cleavage activity then initiates trans-cleavage activity (i.e., multi-turnover activity) of the nucleic acid-guided nuclease, where trans-cleavage is indiscriminate, leading to non-sequence-specific cutting of nucleic acid molecules by the nucleic acid-guided nuclease of RNP1 (102). This trans-cleavage activity triggers activation of blocked ribonucleoprotein complexes (RNP2s) (108) in various ways, which are described in detail below. Each newly activated RNP2 (110) activates more RNP2 (108→110), which in turn cleave reporter moieties (112). The reporter moieties (112) may be a synthetic molecule linked or conjugated to a quencher (114) and a fluorophore (116) such as, for example, a probe with a dye label (e.g., FAM or FITC) on the 5' end and a quencher on the 3' end. The quencher (114) and fluorophore (116) can be about 20-30 bases apart (or about 10-11 nm apart) or less for effective quenching via fluorescence resonance energy transfer (FRET). Reporter moieties also are described in greater detail below.

Figure 4:
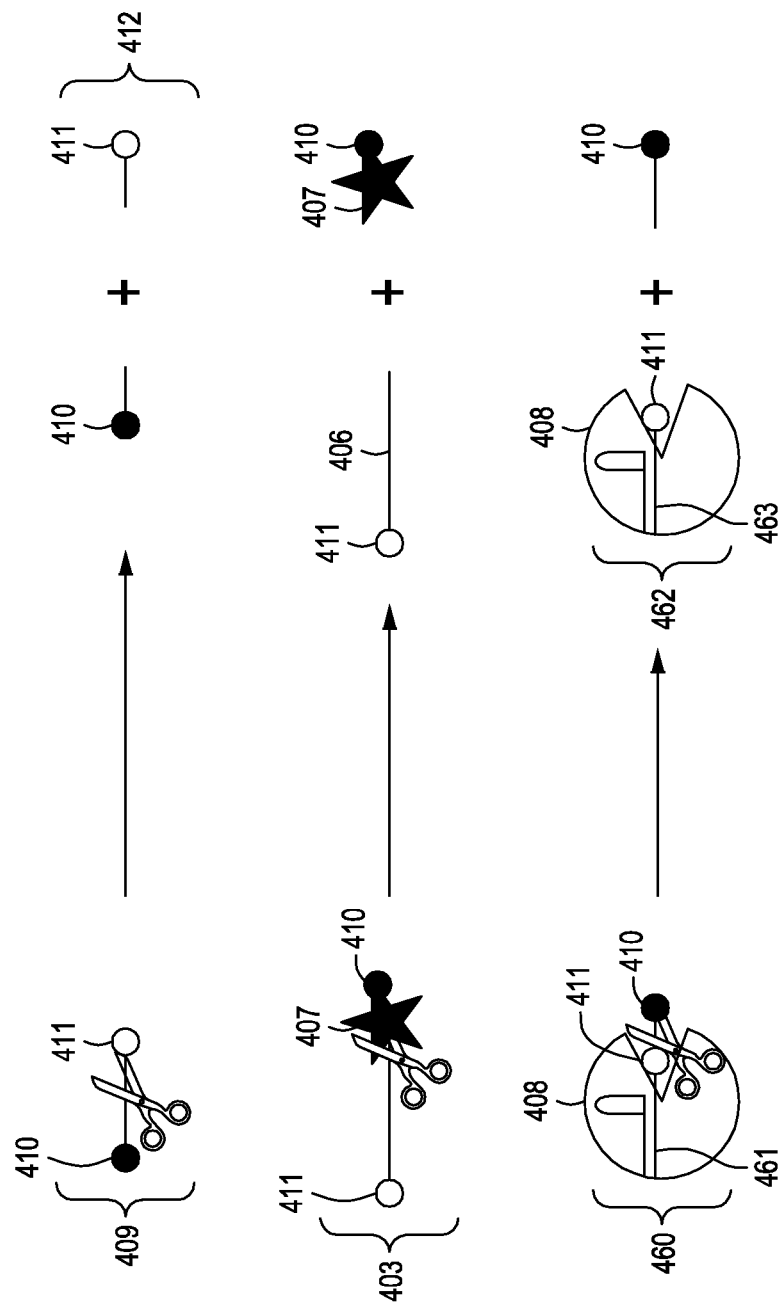
FIG. 4 illustrates three embodiments of reporter moieties.

As more RNP2s are activated (108→110), more trans-cleavage activity is activated and more reporter moieties are activated (where here, "activated" means unquenched); thus, the binding of the target nucleic acid of interest (104) to RNP1 (102) initiates what becomes a cascade of signal production (120), which increases exponentially; hence, the terms "signal amplification" or "signal boost." The cascade assay thus comprises a single turnover event that triggers a multi-turnover event that then triggers another multi-turnover event in a "cascade." As described below in relation to FIG. 4, the reporter moieties (112) may be provided as molecules that are separate from the other components of the nucleic acid-guided nuclease cascade assay, or the reporter moieties may be covalently or non-covalently linked to the blocked nucleic acid molecules or synthesized activating molecules (i.e., the target molecules for the RNP2).

As described in detail below, the present description presents three modalities for minimizing undesired unwinding of the blocked nucleic acid molecules (or blocked primer molecules), which possess regions of double-strand DNA, where such unwinding can lead to non-specific signal generation and false positives. The modalities are 1) altering the ratio of the nucleic acid-guided nuclease in RNP2 to the blocked nucleic acid molecules in contravention to the common wisdom for CRISPR detection/diagnostic assays; 2) engineering the nucleic acid-guided nuclease used in RNP2 so that recognition of double-stranded DNA occurs more slowly than for single-strand DNA, in contravention to nucleic acid-guided nucleases that are used in other CRISPR-based detection assays; and 3) modifying the 5' and/or 3' ends and/or various internal nucleic acid bases of the blocked nucleic acid molecules. One, two or all three of these modalities may be employed in a given assay.

Figure 1C:
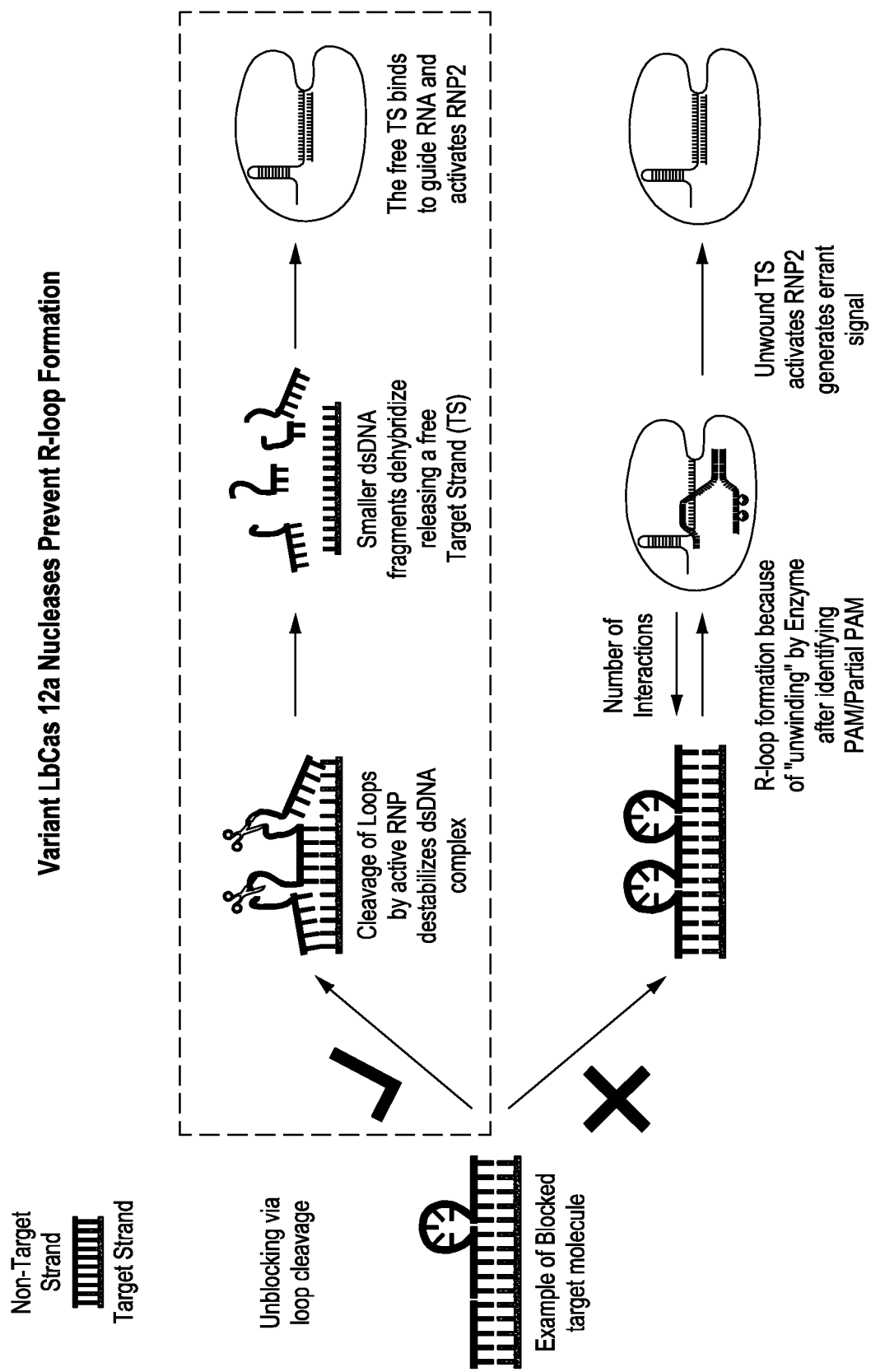
FIG. 1C is an illustration of the unwinding issue that is mitigated by the modalities described herein.

FIG. 1C is an illustration of the effects of unwinding. FIG. 1C shows at left a double-strand blocked nucleic acid molecule comprising a target strand and a non-target strand, where the non-target strand comprises regions (shown as loops) unhybridized to the target strand. Proceeding right at top, cleavage of the loops in the non-target strand by trans-cleavage initiated by RNP1 or RNP2 destabilizes the double-strand blocked nucleic acid molecule; that is, the now short regions of the non-target strand that are hybridized to the target strand become destabilized and dehybridize. As these short regions dehybridize, the target strand is released and can bind to gRNA2 in RNP2, triggering cis-cleavage of the target strand followed by trans-cleavage of additional blocked nucleic acid molecules. This process is the signal boost assay working as designed.

The pathway at the bottom of FIG. 1C illustrates the effect of undesired unwinding; that is, unwinding due not to trans-cleavage as designed but by other unwinding due to recognition of the blocked nucleic acid molecule by gRNA2 and the nucleic acid-guided nuclease in RNP2. As seen in the alternative pathway at bottom of FIG. 1C, R-loop formation between RNP2 and the blocked nucleic acid molecule (or blocked primer molecule) can still occur due to unwinding of the blocked nucleic acid molecule after gRNA2 identifies the PAM. Indeed, this unwinding can occur even in the absence of a PAM. It is an inherent characteristic of the biology of nucleic acid-guided nucleases.

Various components of the cascade assay, descriptions of how the cascade assays work, and the modalities used to minimize undesired unwinding of the blocked nucleic acid molecules (or blocked primer molecules) are described in detail below.

Target Nucleic Acids of Interest

The target nucleic acid of interest may be a DNA, RNA, or cDNA molecule. Target nucleic acids of interest may be isolated from a sample or organism by standard laboratory techniques or may be synthesized by standard laboratory techniques (e.g., RT-PCR). The target nucleic acids of interest are identified in a sample, such as a biological sample from a subject (including non-human animals or plants), items of manufacture, or an environmental sample (e.g., water or soil). Non-limiting examples of biological samples include blood, serum, plasma, saliva, mucus, a nasal swab, a buccal swab, a cell, a cell culture, and tissue. The source of the sample could be any mammal, such as, but not limited to, a human, primate, monkey, cat, dog, mouse, pig, cow, horse, sheep, and bat. Samples may also be obtained from any other source, such as air, water, soil, surfaces, food, beverages, nutraceuticals, clinical sites or products, industrial sites (including food processing sites) and products, plants and grains, cosmetics, personal care products, pharmaceuticals, medical devices, agricultural equipment and sites, and commercial samples.

In some embodiments, the target nucleic acid of interest is from an infectious agent (e.g., a bacteria, protozoan, insect, worm, virus, or fungus) that affects mammals, including humans. As a non-limiting example, the target nucleic acid of interest could be one or more nucleic acid molecules from bacteria, such as *Bordetella parapertussis, Bordetella pertussis, Chlamydia pneumoniae, Legionella pneumophila, Mycoplasma pneumoniae, Acinetobacter calcoaceticus-baumannii* complex, *Bacteroides fragilis, Enterobacter cloacae* complex, *Escherichia coli, Klebsiella aerogenes, Klebsiella oxytoca, Klebsiella pneumoniae* group, *Moraxella catarrhalis, Proteus* spp., *Salmonella enterica, Serratia marcescens, Haemophilus influenzae, Neisseria meningitidis, Pseudomonas aeruginosa, Stenotrophomonas maltophilia, Enterococcus faecalis, Enterococcus faecium, Listeria monocytogenes, Staphylococcus aureus, Staphylococcus epidermidis, Staphylococcus lugdunensis, Streptococcus agalactiae, Streptococcus pneumoniae, Streptococcus pyogenes, Chlamydia tracomatis, Neisseria gonorrhoeae,* Syphilis (*Treponema pallidum*), *Ureaplasma urealyticum, Mycoplasma genitalium,* and/or *Gardnerella vaginalis*. Also, as a non-limiting example, the target nucleic acid of interest could be one or more nucleic acid molecules from a virus, such as adenovirus, coronavirus HKU1, coronavirus NL63, coronavirus 229E, coronavirus OC43, severe acute respiratory syndrome coronavirus 2 (SARS-CoV-2), human metapneumovirus, human rhinovirus, enterovirus, influenza A, influenza A/H1, influenza A/_3, influenza A/11-2009, influenza B, parainfluenza virus 1, parainfluenza virus 2, parainfluenza virus 3, parainfluenza virus 4, respiratory syncytial virus, herpes simplex virus 1, herpes simplex virus 2, human immunodeficiency virus (HIV), human papillomavirus, hepatitis A virus (HAV), hepatitis B virus (HBV), hepatitis C virus (HCV), and/or human parvovirus B 19 (B 19V). Also, as a non-limiting example, the target nucleic acid of interest could be one or more nucleic acid molecules from a fungus, such as *Candida albicans, Candida auris, Candida glabrata, Candida krusei, Candida parapsilosis, Candida tropicalis, Cryptococcus neoformans,* and/or *Cryptococcus gattii*. As another non-limiting example, the target nucleic acid of interest could be one or more nucleic acid molecules from a protozoan, such as *Trichomonas vaginalis*. See, e.g., Table 1 for an exemplary list of human pathogens, Table 2 for an exemplary list of human sexually transmissible diseases.

TABLE 1

Human Pathogens

| Name | Category | NCBI Taxonomy ID | NCBI Sequence ID Number |
|---|---|---|---|
| *Acinetobacter baumannii* | Bacteria | 470 | GCF_008632635.1 |
| *Acinetobacter calcoaceticus* | Bacteria | 471 | GCF_002055515.1 |
| *Acinetobacter calcoaceticus-baumannii complex* | Bacteria | 909768 | Not applicable |
| *Anaplasma phagocytophilum* | Bacteria | 948 | GCF_000439775.1 |
| *Bacillus anthracis* | Bacteria | 1392 | GCF_000008445.1 |
| *Bacteroides fragilis* | Bacteria | 817 | GCF_016889925.1 |
| *Bartonella henselae* | Bacteria | 38323 | GCF_000612965.1 |
| *Bordetella parapertussis* | Bacteria | 519 | GCF_004008295.1 |
| *Bordetella pertussis* | Bacteria | 520 | GCF_004008975.1 |
| *Borrelia mayonii* | Bacteria | 1674146 | GCF_001936295.1 |
| *Borrelia miyamotoi* | Bacteria | 47466 | GCF_003431845.1 |
| *Brucella abortus* | Bacteria | 235 | GCF_000054005.1 |
| *Brucella melitensis* | Bacteria | 29459 | GCF_000007125.1 |
| *Brucella suis* | Bacteria | 29461 | GCF_000007505.1 |
| *Burkholderia mallei* | Bacteria | 13373 | GCF_002346025.1 |
| *Burkholderia pseudomallei* | Bacteria | 28450 | GCF_000756125.1 |
| *Campylobacter jejuni* | Bacteria | 197 | GCF_000009085.1 |
| *Chlamydia pneumoniae* | Bacteria | 83558 | GCF_000007205.1 |
| *Chlamydia psittaci* | Bacteria | 83554 | GCF_000204255.1 |
| *Chlamydia Tracomatis* | Bacteria | 813 | GCF_000008725.1 |
| *Clostridium botulinum* | Bacteria | 1491 | GCF_000063585.1 |
| *Clostridium perfringens* | Bacteria | 1502 | GCF_020138775.1 |
| *Coxiella burnetii* | Bacteria | 777 | GCF_000007765.2 |
| *Ehrlichia chaffeesis* | Bacteria | 945 | GCF_000632965.1 |
| *Ehrlichia ewingii* | Bacteria | 947 | Not available |
| *Ehrlichia ruminantium* | Bacteria | 779 | GCF_013460375.1 |
| *Enterobacter cloacae* | Bacteria | 550 | GCF_000770155.1 |
| *Enterobacter cloacae complex* | Bacteria | 354276 | Not applicable |
| *Enterococcus faecalis* | Bacteria | 1351 | GCF_000393015.1 |
| *Enterococcus faecium* | Bacteria | 1352 | GCF_009734005.1 |
| *Escherichia coli* | Bacteria | 562 | GCF_000008865.2 |
| *Francisella tularensis* | Bacteria | 263 | GCF_000156415.1 |
| *Gardnerella vaginalis* | Bacteria | 2702 | GCF_002861965.1 |
| *Haemophilus influenzae* | Bacteria | 727 | GCF_000931575.1 |
| *Klebsiella aerogenes* | Bacteria | 548 | GCF_007632255.1 |
| *Klebsiella oxytoca* | Bacteria | 571 | GCF_003812925.1 |

TABLE 1-continued

Human Pathogens

| Name | Category | NCBI Taxonomy ID | NCBI Sequence ID Number |
|---|---|---|---|
| Klebsiella pneumoniae | Bacteria | 573 | GCF_000240185.1 |
| Legionella pneumophila | Bacteria | 446 | GCF_001753085.1 |
| Leptospira interrogans | Bacteria | 173 | GCF_002073495.2 |
| Leptospira kirschneri | Bacteria | 29507 | GCF_000243695.2 |
| Leptospira wolffii | Bacteria | 409998 | GCF_004770635.1 |
| Listeria monocytogenes | Bacteria | 1639 | GCF_000196035.1 |
| Moraxella catarrhalis | Bacteria | 480 | GCF_002080125.1 |
| Mycobacterium tuberculosis | Bacteria | 1773 | GCF_000195955.2 |
| Mycoplasma genitalium | Bacteria | 2097 | GCF_000027325.1 |
| Mycoplasma pneumoniae | Bacteria | 2104 | GCF_900660465.1 |
| Neisseria gonorrhoeae | Bacteria | 485 | GCF_013030075.1 |
| Neisseria meningitidis | Bacteria | 487 | GCF_008330805.1 |
| Proteus hauseri | Bacteria | 183417 | GCF_004116975.1 |
| Proteus mirabilis | Bacteria | 584 | GCF_000069965.1 |
| Proteus penneri | Bacteria | 102862 | GCF_022369495.1 |
| Proteus vulgaris | Bacteria | 585 | GCF_000754995.1 |
| Pseudomonas aeruginosa | Bacteria | 287 | GCF_000006765.1 |
| Rickettsia parkeri | Bacteria | 35792 | GCF_005549115.1 |
| | | | GCA_018610945.1 |
| | | | GCF_000965075.1 |
| | | | GCF_000965085.1 |
| | | | GCF_000284195.1 |
| | | | GCF_000965145.1 |
| Rickettsia prowazekii | Bacteria | 782 | GCF_000277165.1 |
| Rickettsia rickettsii | Bacteria | 783 | GCF_000017445.4 |
| Salmonella bongori | Bacteria | 54736 | GCF_000439255.1 |
| Salmonella enterica | Bacteria | 28901 | GCF_000006945.2 |
| Salmonella enterica | Bacteria | 28901 | GCF_000006945.2 |
| Serratia marcescens | Bacteria | 615 | GCF_003516165.1 |
| Shigella boydii | Bacteria | 621 | GCF_001905915.1 |
| Shigella dysenteriae | Bacteria | 622 | GCF_001932995.2 |
| Shigella flexneri | Bacteria | 623 | GCF_000006925.2 |
| Shigella sonnei | Bacteria | 624 | GCF_013374815.1 |
| Staphylococcus auerus | Bacteria | 1280 | GCF_000013425.1 |
| Staphylococcus enterotoxin B | Bacteria | 1280 | U93688.2 |
| Staphylococcus epidermidis | Bacteria | 1282 | GCF_006094375.1 |
| Staphylococcus lugdunensis | Bacteria | 28035 | GCF_001558775.1 |
| Stenotrophomonas maltophilia | Bacteria | 40324 | GCF_900475405.1 |
| Streptococcus agalactiae | Bacteria | 1311 | GCF_001552035.1 |
| Streptococcus pneumoniae | Bacteria | 1313 | GCF_002076835.1 |
| Streptococcus pyogenes | Bacteria | 1314 | GCF_900475035.1 |
| Treponema pallidum | Bacteria | 160 | GCF_000246755.1 |
| Ureaplasma urealyticum | Bacteria | 2130 | GCF_000021265.1 |
| Vibrio parahaemolyticus | Bacteria | 670 | GCF_000196095.1 |
| Vibrio vulnificus | Bacteria | 672 | GCF_002204915.1 |
| Yersinia enterocolitica | Bacteria | 630 | GCF_001160345.1 |
| Yersinia pestis | Bacteria | 632 | GCF_000222975.1 |
| Candida albicans | Fungus | 5476 | GCF_000182965.3 |
| Candida auris | Fungus | 498019 | GCF_002775015.1 |
| Candida glabrata | Fungus | 5478 | GCF_000002545.3 |
| Candida parapsilosis | Fungus | 5480 | GCF_000182765.1 |
| Candida tropicalis | Fungus | 5482 | GCF_000006335.3 |
| Coccidioides immitis | Fungus | 5501 | GCF_000149335.2 |
| Coccidioides posadasii | Fungus | 199306 | GCF_000151335.1 |
| Cokeromyces recurvatus | Fungus | 90255 | GCA_000697235.1 |
| Cryptococcus gattii | Fungus | 37769 | GCF_000185945.1 |
| Cryptococcus neoformans | Fungus | 5207 | GCF_000091045.1 |
| Cunninghamella bertholletiae | Fungus | 90251 | GCA_000697215.1 |
| Encephalitozoon cuniculi | Fungus | 6035 | GCF_000091225.1 |
| Encephalitozoon hellem | Fungus | 27973 | GCF_000277815.2 |
| Encephalitozoon intestinalis | Fungus | 58839 | GCF_000146465.1 |
| Enterocystozoon bieneusi | Fungus | 31281 | GCF_000209485.1 |
| Mortierella wolfii | Fungus | 90253 | GCA_016098105.1 |
| Pichia kudriavzevii | Fungus | 4909 | GCF_003054445.1 |
| Saksenaea vasiformis | Fungus | 90258 | GCA_000697055.1 |
| Syncephalastrum racemosum | Fungus | 13706 | GCA_002105135.1 |
| Trichomonas vaginalis | Fungus | 5722 | GCF_000002825.2 |
| Ricinus communis | Plant | 3988 | GCF_019578655.1 |
| Acanthamoeba castellanii | Protozoa | 5755 | GCF_000313135.1 |
| Babesia divergens | Protozoa | 32595 | GCA_001077455.2 |
| Babesia microti | Protozoa | 5868 | GCF_000691945.2 |
| Balamuthia mandrillaris | Protozoa | 66527 | GCA_001185145.1 |
| Cryptosporidium parvum | Protozoa | 5807 | GCF_000165345.1 |
| Cyclospora cayatanensis | Protozoa | 88456 | GCF_002999335.1 |
| Entamoeba histolytica | Protozoa | 5759 | GCF_000208925.1 |
| Giardia lamblia | Protozoa | 5741 | GCF_000002435.2 |
| Naegleria fowleri | Protozoa | 5763 | GCF_008403515.1 |
| Toxoplasma gondii | Protozoa | 5811 | GCF_000006565.2 |
| Alkhumra hemorrhagic fever virus | Virus | 172148 | JF416961.1 |
| Argentinian mammarenavirus | Virus | 2169991 | GCF_000856545.1 |
| Betacoronavirus 1 | Virus | 694003 | GCF_000862505.1 |
| | | | GCF_003972325.1 |
| Black Creek Canal orthohantavirus | Virus | 1980460 | GCF_002817355.1 |
| California encephalitis orthobunyavirus | Virus | 1933264 | GCF_003972565.1 |
| Chapare mammarenavirus | Virus | 499556 | GCF_000879235.1 |
| Chikungunya virus | Virus | 37124 | GCF_000854045.1 |
| Crimean-Congo hemorrhagic fever orthnairovirus | Virus | 1980519 | GCF_000854165.1 |
| Dabie bandavirus | Virus | 2748958 | GCF_000897355.1 |
| | | | GCF_003087855.1 |
| Deer tick virus | Virus | 58535 | MZ148230 to MZ148271 |
| Dengue virus 1 | Virus | 11053 | GCF_000862125.1 |
| Dengue virus 2 | Virus | 11060 | GCF_000871845.1 |
| Dengue virus 3 | Virus | 11069 | GCF_000866625.1 |
| Dengue virus 4 | Virus | 11070 | GCF_000865065.1 |
| Eastern equine encephalitis virus | Virus | 11021 | GCF_000862705.1 |
| Enterovirus A | Virus | 138948 | GCF_002816655.1 |
| | | | GCF_000861905.1 |
| | | | GCF_001684625.1 |
| Enterovirus B | Virus | 138949 | GCF_002816685.1 |
| | | | GCF_000861325.1 |
| Enterovirus C | Virus | 138950 | GCF_000861165.1 |
| Enterovirus D | Virus | 138951 | GCF_000861205.1 |
| | | | GCF_002816725.1 |
| Guanarito mammarenavirus | Virus | 45219 | GCF_000853765.1 |
| Heartland bandavirus | Virus | 2747342 | GCF_000922255.1 |
| Hendra henipavirus | Virus | 63330 | GCF_000852685.1 |
| Hepacivirus C | Virus | 11103 | GCF_002820805.1 |
| | | | GCF_000861845.1 |
| | | | GCF_000871165.1 |
| | | | GCF_000874285.1 |
| | | | GCF_001712785.1 |
| hepatitis A virus | Virus | 208726 | K02990.1 |
| | | | M14707.1 |
| | | | M20273.1 |
| | | | X75215.1 |
| | | | AB020564.1 |
| hepatitis B virus | Virus | 10407 | GCF_000861825.2 |
| hepatitis C virus | Virus | 11103 | GCF_002820805.1 |
| | | | GCF_000861845.1 |
| | | | GCF_000871165.1 |
| | | | GCF_000874285.1 |
| | | | GCF_000874265.1 |
| | | | GCF_001712785.1 |
| Hepatovirus A | Virus | 12092 | GCF_000860505.1 |
| Human adenovirus A | Virus | 129875 | GCF_000846805.1 |
| Human adenovirus B | Virus | 108098 | GCF_000857885.1 |
| Human adenovirus C | Virus | 129951 | GCF_000858645.1 |
| Human adenovirus D | Virus | 130310 | GCF_000885675.1 |
| Human adenovirus E | Virus | 130308 | GCF_000897015.1 |
| Human adenovirus F | Virus | 130309 | GCF_000846685.1 |
| Human adenovirus G | Virus | 536079 | GCF_000847325.1 |
| Human alphaherpesvirus 1 | Virus | 10298 | GCF_000859985.2 |
| Human alphaherpesvirus 2 | Virus | 10310 | GCF_000858385.2 |
| human betaherpesvirus 6A | Virus | 32603 | GCF_000845685.2 |
| human betaherpesvirus 6B | Virus | 32604 | GCF_000846365.1 |

TABLE 1-continued

Human Pathogens

| Name | Category | NCBI Taxonomy ID | NCBI Sequence ID Number |
|---|---|---|---|
| Human coronavirus 229E | Virus | 11137 | GCF_001500975.1 |
| | | | GCF_000853505.1 |
| Human coronavirus HKU1 | Virus | 290028 | GCF_000858765.1 |
| Human coronavirus NL63 | Virus | 277944 | GCF_000853865.1 |
| Human coronavirus OC43 | Virus | 31631 | GCF_003972325.1 |
| Human gammaherpesvirus 8 | Virus | 37296 | GCF_000838265.1 |
| Human immunodeficiency virus 1 | Virus | 11676 | GCF_000864765.1 |
| Human immunodeficiency virus 2 | Virus | 11709 | GCF_000856385.1 |
| human metapneumovirus | Virus | 162145 | GCF_002815375.1 |
| human papillomavirus | Virus | | GCF_001274345.1 |
| Human polyomavirus 1 | Virus | 1891762 | GCF_000837865.1 |
| Human polyomavirus 2 | Virus | 1891763 | GCF_000863805.1 |
| human rhinovirus A | Virus | 147711 | GCF_000862245.1 |
| | | | GCF_002816835.1 |
| human rhinovirus B | Virus | 147712 | GCF_000861265.1 |
| | | | GCF_002816855.1 |
| human rhinovirus C | Virus | 463676 | GCF_002816885.1 |
| | | | GCF_000872325.1 |
| Influenza A virus | Virus | 11320 | GCF_001343785.1 |
| | | | GCF_000851145.1 |
| | | | GCF_000866645.1 |
| Influenza B virus | Virus | 11520 | GCF_000820495.2 |
| Influenza C virus | Virus | 11552 | GCF_000856665.10 |
| Influenza D virus | Virus | 1511084 | GCF_002867775.1 |
| Japanese encephalitis virus | Virus | 11072 | GCF_000862145.1 |
| Kyasanur Forest disease virus | Virus | 33743 | GCF_002820625.1 |
| La Crosse orthobunyavirus | Virus | 2560547 | GCF_000850965.1 |
| Lassa virus | Virus | 11620 | GCF_000851705.1 |
| Lujo mammarenavirus | Virus | 649188 | GCF_000885555.1 |
| Lyssavirus australis | Virus | 90961 | GCF_000850325.1 |
| Marburg virus | Virus | | NC_001608.3 |
| Measles morbillivirus | Virus | 11234 | GCF_000854845.1 |
| Middle East respiratory syndrome-related coronavirus | Virus | 1335626 | GCF_002816195.1 |
| | | | GCF_000901155.1 |
| Monongahela hantavirus | Virus | 2259728 | MH539865 |
| | | | MH539866 |
| | | | MH539867 |
| New York hantavirus | Virus | 44755 | U36803.1 |
| | | | U36802.1 |
| | | | U36801.1 |
| | | | U09488.1 |
| Nipah henipavirus | Virus | 121791 | GCF_000863625.1 |
| Norwalk virus | Virus | 11983 | GCF_000864005.1 |
| | | | GCF_008703965.1 |
| | | | GCF_008703985.1 |
| | | | GCF_008704025.1 |
| | | | GCF_010478905.1 |
| | | | GCF_000868425.1 |
| Omsk hemorrhagic fever virus | Virus | 12542 | GCF_000855505.1 |
| parainfluenza virus 1 | Virus | 12730 | GCF_000848705.1 |
| | | | NC_003461 |
| parainfluenza virus 2 | Virus | | X57559.1 |
| | | | AF533010 |
| | | | AF533011 |
| | | | AF533012 |
| parainfluenza virus 3 | Virus | 11216 | GCA_006298365.1 |
| | | | GCA_000850205.1 |
| parainfluenza virus 4 | Virus | 2560526 | NC_021928.1 |
| Paslahepevirus balayani | Virus | 1678141 | GCF_000861105.1 |
| Poliovirus | Virus | 138950 | GCF_000861165.1 |
| Primate erythroparvovirus 1 | Virus | 1511900 | GCF_000839645.1 |
| Rabies lyssavirus | Virus | 11292 | GCF_000859625.1 |
| respiratory syncytial virus | Virus | 12814 | GCF_000856445.1 |
| Rift Valley virus | Virus | 11588 | HE687302 |
| | | | HE687307 |
| Saint Louis encephalitis virus | Virus | 11080 | GCF_000866785.1 |
| Sapporo virus | Virus | 95342 | GCF_000849945.1 |
| | | | GCF_000855765.1 |
| | | | GCF_000854265.1 |
| | | | GCF_001008475.1 |
| | | | GCF_000853825.1 |
| SARS-related coronavirus | Virus | 694009 | GCF_000864885.1 |
| | | | GCF_009858895.2 |
| Severe acute respiratory syndrome coronavirus 1 | Virus | 2901879 | NC_004718.3 |
| Severe acute respiratory syndrome coronavirus 2 | Virus | 2697049 | NC_045512.2 |
| Sin Nombre virus | Virus | 1980491 | GCF_000854765.1 |
| Tick-borne encephalitis virus | Virus | 11084 | GCF_000863125.1 |
| Variola major | Virus | 12870 | not available |
| Variola minor | Virus | 53258 | not available |
| Variola virus | Virus | 10255 | GCF_000859885.1 |
| Venezuelan equine encephalitis virus | Virus | 11036 | GCF_000862105.1 |
| West Nile virus | Virus | 11082 | GCF_000861085.1 |
| | | | GCF_000875385.1 |
| Western equine encephalitis virus | Virus | 11039 | GCF_000850885.1 |
| Yellow fever virus | Virus | 11089 | GCF_000857725.1 |
| Zaire ebolavirus | Virus | 186538 | GCF_000848505.1 |
| Zika virus | Virus | 64320 | GCF_000882815.3 |
| | | | GCF_002366285.1 |

TABLE 2

Human STD pathogens

| Name | Category | NCBI Taxonomy ID | NCBI Sequence ID Number |
|---|---|---|---|
| *Pthirus pubis* | Animal | 121228 | MT721740.1 |
| *Sarcoptes scabiei* | Animal | 52283 | GCA_020844145.1 |
| *Chlamydia trachomatis* | Bacteria | 813 | GCF_000008725.1 |
| *Gardnerella vaginalis* | Bacteria | 2702 | GCF_002861965.1 |
| *Haemophilus ducreyi* | Bacteria | 730 | GCF_001647695.1 |
| *Mycoplasma genitalium* | Bacteria | 2097 | GCF_000027325.1 |
| *Neisseria gonorrhoeae* | Bacteria | 485 | GCF_013030075.1 |
| *Treponema pallidum* | Bacteria | 160 | GCF_000246755.1 |
| *Trichomonas vaginalis* | Protozoa | 5722 | GCF_000002825.2 |
| *Hepacivirus C* | Virus | 11103 | GCF_002820805.1 |
| Hepatitis B virus | Virus | 10407 | GCF_000861825.2 |
| Hepatitis delta virus | Virus | 12475 | GCF_000856565.1 |
| *Hepatovirus A* | Virus | 12092 | GCF_000860505.1 |
| *Human alphaherpesvirus* 1 | Virus | 10298 | GCF_000859985.2 |
| Human immunodeficiency virus 1 | Virus | 11676 | GCF_000864765.1 |
| Human immunodeficiency virus 2 | Virus | 11709 | GCF_000856385.1 |
| *Human papillomavirus* | Virus | 10566 | GCF_001274345.1 |

Additionally, the target nucleic acid of interest may originate in an organism such as a bacterium, virus, fungus or other pest that infects livestock or agricultural crops. Such organisms include avian influenza viruses, *mycoplasma* and other bovine mastitis pathogens, *Clostridium perfringens*, *Campylobacter* sp., *Salmonella* sp., Pospiviroidae, Avsunviroidae, *Pantoea stewartii, Mycoplasma genitalium, Spiroplasma* sp., *Pseudomonas solanacearum, Erwinia amylovora, Erwinia carotovora, Pseudomonas syringae, Xanthomonas campestris, Agrobacterium tumefaciens, Spiroplasma citri, Phytophthora infestans, Endothia parasitica, Ceratocysis ulmi, Puccinia graminis, Hemilea vastatrix, Ustilage maydis, Ustilage nuda, Guignardia* bidweliji,

*Uncinula necator, Botrytis cincerea, Plasmopara viticola,* or *Botryotinis fuckleina*. See, e.g., Table 3 for an exemplary list of non-human animal pathogens.

TABLE 3

Animal Pathogens

| Name | Category | NCBI Taxonomy ID | NCBI Sequence ID Number |
|---|---|---|---|
| *Acarapis woodi* | Animal | 478375 | GCA_023170135.1 |
| *Aethina tumida* | Animal | 116153 | GCF_001937115.1 |
| *Chorioptes bovis* | Animal | 420257 | |
| *Chrysomya bezziana* | Animal | 69364 | |
| *Cochliomyia hominivorax* | Animal | 115425 | GCA_004302925.1 |
| *Echinococcus granulosus* | Animal | 6210 | GCF_000524195.1 |
| *Echinococcus multilocularis* | Animal | 6211 | GCA_000469725.3 |
| *Gyrodactylus salaris* | Animal | 37629 | GCA_000715275.1 |
| *Psoroptes ovis* | Animal | 83912 | GCA_002943765.1 |
| *Sarcoptes scabiei* | Animal | 52283 | GCA_020844145.1 |
| *Taenia solium* | Animal | 6204 | GCA_001870725.1 |
| *Trichinella britovi* | Animal | 45882 | GCA_001447585.1 |
| *Trichinella nativa* | Animal | 6335 | GCA_001447565.1 |
| *Trichinella nelsoni* | Animal | 6336 | GCA_001447455.1 |
| *Trichinella papuae* | Animal | 268474 | GCA_001447755.1 |
| *Trichinella pseudospiralis* | Animal | 6337 | GCA_001447645.1 |
| *Trichinella spiralis* | Animal | 6334 | GCF_000181795.1 |
| *Trichinella zimbabwensis* | Animal | 268475 | GCA_001447665.1 |
| *Tropilaelaps clareae* | Animal | 208209 | |
| *Tropilaelaps koenigerum* | Animal | 208208 | |
| *Tropilaelaps mercedesae* | Animal | 418985 | GCA_002081605.1 |
| *Tropilaelaps thaii* | Animal | 418986 | |
| *Varroa destructor* | Animal | 109461 | GCF_002443255.1 |
| *Varroa jacobsoni* | Animal | 62625 | GCF_002532875.1 |
| *Varroa rinderei* | Animal | 109259 | |
| *Varroa underwoodi* | Animal | 109260 | |
| *Anaplasma centrale* | Bacteria | 769 | GCF_000024505.1 |
| *Anaplasma marginale* | Bacteria | 770 | GCF_000020305.1 |
| *Bacillus anthracis* | Bacteria | 1392 | GCF_000008445.1 |
| *Brucella abortus* | Bacteria | 235 | GCF_000054005.1 |
| *Brucella melitensis* | Bacteria | 29459 | GCF_000007125.1 |
| *Brucella ovis* | Bacteria | 236 | GCF_000016845.1 |
| *Brucella suis* | Bacteria | 29461 | GCF_000007505.1 |
| *Burkholderia mallei* | Bacteria | 13373 | GCF_002346025.1 |
| *Burkholderia pseudomallei* | Bacteria | 28450 | GCF_000756125.1 |
| *Campylobacter fetus* | Bacteria | 196 | GCF_000015085.1 |
| *Candidatus Xenohaliotis californiensis* | Bacteria | 84677 | |
| *Candidatus Hepatobacter penaei* | Bacteria | 1274402 | GCF_000742475.1 |
| *Chlamydia abortus* | Bacteria | 83555 | GCF_900416725.2 |
| *Chlamydia psittaci* | Bacteria | 83554 | GCF_000204255.1 |
| *Corynebacterium pseudotuberculosis* | Bacteria | 1719 | GCF_001865765.1 |
| *Coxiella burnetii* | Bacteria | 777 | GCF_000007765.2 |
| *Ehrlichia ruminantium* | Bacteria | 779 | GCF_013460375.1 |
| *Francisella tularensis* | Bacteria | 263 | GCF_000156415.1 |
| *Melissococcus plutonius* | Bacteria | 33970 | GCF_003966875.1 |
| *Mycobacterium avium* | Bacteria | 1764 | GCF_000696715.1 |
| *Mycobacterium tuberculosis* | Bacteria | 1773 | GCF_000195955.2 |
| *Mycoplasma capricolum* | Bacteria | 2095 | GCF_000012765.1 |
| *Mycoplasma gallisepticum* | Bacteria | 2096 | GCF_000286675.1 |
| *Mycoplasma mycoides* | Bacteria | 2102 | GCF_000023685.1 |
| *Mycoplasma putrefaciens* | Bacteria | 2123 | GCF_900476175.1 |
| *Mycoplasmopsis agalactiae* | Bacteria | 2110 | GCF_009150585.1 |
| *Mycoplasmopsis synoviae* | Bacteria | 2109 | GCF_013393745.1 |
| *Paenibacillus larvae* | Bacteria | 1464 | GCF_002951935.1 |
| *Pasteurella multocida* | Bacteria | 747 | GCF_000006825.1 |
| *Salmonella enterica* | Bacteria | 28901 | GCF_000006945.2 |
| *Streptococcus equi* | Bacteria | 1336 | GCF_015689455.1 |
| *Taylorella equigenitalis* | Bacteria | 29575 | GCF_002288025.1 |
| *Vibrio parahaemolyticus* | Bacteria | 670 | GCF_000196095.1 |
| *Batrachochytrium dendrobatidis* | Fungi | 109871 | GCF_000203795.1 |
| *Batrachochytrium salamandrivorans* | Fungi | 1357716 | GCA_021556675.1 |
| *Aphanomyces astaci* | Oomycota | 112090 | GCF_000520075.1 |
| *Aphanomyces invadans* | Oomycota | 157072 | GCF_000520115.1 |
| *Babesia bigemina* | Protozoa | 5866 | GCF_000981445.1 |
| *Babesia bovis* | Protozoa | 5865 | GCA_000165395.2 |
| *Babesia caballi* | Protozoa | 5871 | |
| *Bonamia exitiosa* | Protozoa | 362532 | |
| *Bonamia ostreae* | Protozoa | 126728 | |
| *Leishmania amazonensis* | Protozoa | 5659 | GCA 005317125.1 |
| *Leishmania braziliensis* | Protozoa | 5660 | GCF_000002845.2 |
| *Leishmania donovani* | Protozoa | 5661 | GCF_000227135.1 |
| *Leishmania infantum* | Protozoa | 5671 | GCF_000002875.2 |
| *Leishmania major* | Protozoa | 5664 | GCF_000002725.2 |
| *Leishmania mexicana* | Protozoa | 5665 | GCF_000234665.1 |
| *Leishmania tropica* | Protozoa | 5666 | GCA_014139745.1 |
| *Marteilia refringens* | Protozoa | 107386 | |
| *Perkinsus marinus* | Protozoa | 31276 | GCF_000006405.1 |
| *Perkinsus olseni* | Protozoa | 32597 | GCA_013115135.1 |
| *Theileria annulata* | Protozoa | 5874 | GCF_000003225.4 |
| *Theileria equi* | Protozoa | 5872 | GCF_000342415.1 |
| *Theileria parva* | Protozoa | 5875 | GCF_000165365.1 |
| *Tritrichomonas foetus* | Protozoa | 1144522 | GCA_001839685.1 |
| *Trypanosoma brucei* | Protozoa | 5691 | GCF_000002445.2 |
| *Trypanosoma congolense* | Protozoa | 5692 | GCA_002287245.1 |
| *Trypanosoma equiperdum* | Protozoa | 5694 | GCA_001457755.2 |
| *Trypanosoma evansi* | Protozoa | 5697 | GCA_917563935.1 |
| *Trypanosoma vivax* | Protozoa | 5699 | GCA_021307395.1 |
| African horse sickness virus | Virus | 40050 | GCF_000856125.1 |
| African swine fever virus | Virus | 10497 | GCF_000858485.1 |
| Akabane orthobunyavirus | Virus | 1933178 | GCF_000871205.1 |
| *Alcelaphine gammaherpesvirus 1* | Virus | 35252 | GCF_000838825.1 |
| *Alphaarterivirus equid* | Virus | 2499620 | GCF_000860865.1 |
| *Alphacoronavirus 1* | Virus | 693997 | GCF_000856025.1 |
| Ambystoma tigrinum virus | Virus | 265294 | GCF_000841005.1 |
| Avian coronavirus | Virus | 694014 | GCF_012271565.1 |
| Avian influenza virus | Virus | 11309 | |
| Avian metapneumovirus | Virus | 38525 | GCF_002989735.1 |
| *Avian orthoavulavirus 1* | Virus | 2560319 | GCF_002834085.1 |
| *Avihepatovirus A* | Virus | 691956 | GCF_000869945.1 |
| *Betaarterivirus suid 1* | Virus | 2499680 | GCF_003971765.1 |
| Bluetongue virus | Virus | 40051 | GCF_000854445.3 |
| *Bovine alphaherpesvirus 1* | Virus | 10320 | GCF_008777455.1 |
| Bovine leukemia virus | Virus | 11901 | GCF_000853665.1 |
| Camelpox virus | Virus | 28873 | GCF_000839105.1 |
| Caprine arthritis encephalitis virus | Virus | 11660 | GCF_000857525.1 |
| Crimean-Congo hemorrhagic fever orthonairovirus | Virus | 1980519 | GCF_000854165.1 |
| *Cyprinid herpesvirus 3* | Virus | 180230 | GCF_000871465.1 |
| *Decapod iridescent virus 1* | Virus | 2560405 | GCF_004788555.1 |
| *Decapod penstyldensovirus 1* | Virus | 1513224 | GCF_000844705.1 |
| Deformed wing virus | Virus | 198112 | GCF_000852585.1 |
| Eastern equine encephalitis virus | Virus | 11021 | GCF_000862705.1 |
| Epizootic haematopoietic necrosis virus | Virus | 100217 | GCF_001448375.1 |
| Epizootic hemorrhagic disease virus | Virus | 40054 | GCF_000885335.1 |
| *Equid alphaherpesvirus 1* | Virus | 10326 | GCF_000844025.1 |
| *Equid alphaherpesvirus 4* | Virus | 10331 | GCF_000846345.1 |
| Equine infectious anemia virus | Virus | 11665 | GCF_000847605.1 |
| Foot-and-mouth disease virus | Virus | 12110 | GCF_002816555.1 |
| Frog virus 3 | Virus | 10493 | GCF_002826565.1 |
| *Gallid alphaherpesvirus 1* | Virus | 10386 | GCF_000847005.1 |
| Goatpox virus | Virus | 186805 | GCF_000840165.1 |
| *Haliotid herpesvirus 1* | Virus | 1513231 | GCF_000900375.1 |
| *Hendra henipavirus* | Virus | 63330 | GCF_000852675.1 |
| Infectious bursal disease virus | Virus | 10995 | GCF_000855485.1 |
| Infectious spleen and kidney necrosis virus | Virus | 180170 | GCF_000848865.1 |
| Influenza A virus | Virus | 11320 | GCF_000851145.1 |

TABLE 3-continued

Animal Pathogens

| Name | Category | NCBI Taxonomy ID | NCBI Sequence ID Number |
|---|---|---|---|
| Isavirus salaris | Virus | 55987 | GCF_000854145.2 |
| Japanese encephalitis virus | Virus | 11072 | GCF_000862145.1 |
| Lumpy skin disease virus | Virus | 59509 | GCF_000839805.1 |
| Lyssavirus rabies | Virus | 11292 | GCF_000859625.1 |
| Macrobrachium rosenbergii nodavirus | Virus | 222557 | GCA_000856985.1 |
| Middle East respiratory syndrome-related coronavirus | Virus | 1335626 | GCF_002816195.1 |
| Myxoma virus | Virus | 10273 | GCF_000843685.1 |
| Nairobi sheep disease orthonairovirus | Virus | 1980526 | GCF_002117695.1 |
| Nipah henipavirus | Virus | 121791 | GCF_000863625.1 |
| Norwegian salmonid alphavirus | Virus | 344701 | |
| Novirhabdovirus piscine | Virus | 1980916 | GCF_000856505.1 |
| Novirhabdovirus salmonid | Virus | 1980917 | GCF_000850065.1 |
| Penaeid shrimp infectious myonecrosis virus | Virus | 282786 | GCA_000866305.1 |
| Peste des petits ruminants virus | Virus | 2593991 | GCF_000866445.1 |
| Pestivirus C | Virus | 2170082 | GCF_000864685.1 GCF_003034095.1 |
| Pestivirus A | Virus | 2170080 | GCF_000861245.1 |
| Rabbit hemorrhagic disease virus | Virus | 11976 | GCF_000861285.1 |
| Rift Valley fever phlebovirus | Virus | 1933187 | GCF_000847345.1 |
| Rinderpest morbillivirus | Virus | 11241 | GCF_000856645.1 |
| Severe acute respiratory syndrome-related coronavirus | Virus | 694009 | GCF_000864885.1 |
| Sheeppox virus | Virus | 10266 | GCF_000840205.1 |
| Slow bee paralysis virus | Virus | 458132 | GCF_000887395.1 |
| Sprivirus cyprinus | Virus | 696863 | GCF_000850305.1 |
| Suid alphaherpesvirus 1 | Virus | 10345 | GCF_000843825.1 |
| Swine vesicular disease virus | Virus | 12075 | |
| Taura syndrome virus | Virus | 142102 | GCF_000849385.1 |
| Tilapinevirus tilapiae | Virus | 2034996 | GCF_001630085.1 |
| Venezuelan equine encephalitis virus | Virus | 11036 | GCF_000862105.1 |
| Vesiculovirus indiana | Virus | 1972577 | GCF_000850045.1 |
| Visna-maedi virus | Virus | 2169971 | GCF_000849025.1 |
| West Nile Virus | Virus | 11082 | GCF_000861085.1 |
| Western equine encephalitis virus | Virus | 11039 | GCF_000850885.1 |
| White spot syndrome virus | Virus | 342409 | GCF_000848085.2 |
| Yellow head virus | Virus | 96029 | GCF_003972805.1 |

In some embodiments, other target nucleic acids of interest may be for non-infectious conditions, e.g., to be used for genotyping, including non-invasive prenatal diagnosis of, e.g., trisomies, other chromosomal abnormalities, and known genetic diseases such as Tay Sachs disease and sickle cell anemia. Other target nucleic acids of interest and samples are described herein, such as human biomarkers for cancer. An exemplary list of human biomarkers is in Table 4. Target nucleic acids of interest may include engineered biologics, including cells such as CAR-T cells, or target nucleic acids of interest from very small or rare samples, where only small volumes are available for testing.

TABLE 4

Human Biomarkers

| Biomarker | Disease | Sample | NCBI Taxonomy ID | NCBI Gene ID |
|---|---|---|---|---|
| Aβ42, amyloid beta-protein | Alzheimer disease | CSF | 9606 | 351 |
| prion protein | Alzheimer disease, prion disease | CSF | 9606 | 5621 |
| Vitamin D binding protein | multiple sclerosis progression | CSF | 9606 | 2638 |
| CXCL13 | multiple sclerosis | CSF | 9606 | 10563 |
| alpha-synuclein | parkinsonian disorders | CSF | 9606 | 6622 |
| tau protein | parkinsonian disorders | CSF | 9606 | 4137 |
| Apo II | parkinsonian disorders | CSF | 9606 | 336 |
| ceruloplasmin | parkinsonian disorders | CSF | 9606 | 1356 |
| peroxisome proliferation-activated PD receptor | parkinsonian disorders | CSF | 9606 | 5467 |
| parkin | neurogenerative disorders | CSF | 9606 | 5071 |
| PTEN induced putative kinase I | neurogenerative disorders | CSF | 9606 | 65018 |
| DJ-1 (PARK7) | neurogenerative disorders | CSF | 9606 | 11315 |
| leucine-rich repeat kinase | neurogenerative disorders | CSF | 9606 | 120892 |
| secretogranin II | bipolar disorder | CSF | 9606 | 7857 |
| neurofilament light chain | axonal degeneration | CSF | 9606 | 4747 |
| IL-12B, CXDL13, IL-8 | Intrathecal inflammation | CSF | 9606 | 3593, 10563, 3576 |
| ACE2 | cardiovascular disease | blood | 9606 | 59272 |
| alpha-amylase | cardiovascular disease | saliva | 9606 | 276 |
| alpha-feto protein | pregnancy | blood | 9606 | 174 |
| albumin | urine | diabetes | 9606 | 213 |
| albumin, urea | albuminuria | urine | 9606 | 213 |

TABLE 4-continued

Human Biomarkers

| Biomarker | Disease | Sample | NCBI Taxonomy ID | NCBI Gene ID |
|---|---|---|---|---|
| neutrophil gelatinase-associated lipocalin (NGAL) | acute kidney injury | urine | 9606 | 3934 |
| IL-18 | acute kidney injury | urine | 9606 | 3606 |
| liver fatty acid binding protein | acute kidney injury | urine | 9606 | 2168 |
| Dkk-3 | prostate cancer | semen | 9606 | 27122 |
| autoantibody to CD25 | early diagnosis esophageal squamous cell carcinoma | blood | 9606 | |
| hTERT | lung cancer | blood | 9606 | 7015 |
| CA125 (MUC16) | lung cancer | blood | 9606 | 94025 |
| VEGF | lung cancer | blood | 9606 | 7422 |
| IL-2 | lung cancer | blood | 9606 | 3558 |
| osteopontin | lung cancer | blood | 9606 | 6696 |
| BRAF, CCNI, EGRF, FGF19, FRS2, GREB1, and LZTS1 | lung cancer | saliva | 9606 | 673, 16007, 1956, 9965, 10818, 9687, 11178 |
| human epididymis protein 4 | ovarian cancer | blood | 9606 | 10406 |
| CA125 | ovarian cancer | saliva | 9606 | 94025 |
| EMP1 | nasopharyngeal carcinoma | saliva | 9606 | 13730 |
| IL-8 | oral cancer | saliva | 9606 | 3576 |
| carcinoembryonic antigen | oral or salivary malignant tumors | saliva | 9606 | 1048 |
| thioredoxin | Spinalcellular carcinoma | saliva | 9606 | 7295 |
| AIP (aryl hydrocarbon receptor interacting protein) | Acute intermittent porphyria, somatotroph adenoma, prolactin-producing pituitary gland adenoma | blood | 9606 | 9049 |
| ALK receptor tyrosine kinase | Neuroblastoma susceptibility, large cell lymphoma | blood | 9606 | 238 |
| BAP1 (BRCA1 associated protein 1) | BAP1-related tumor predisposition, melanoma susceptibility | blood | 9606 | 8314 |
| BLM | Bloom syndrome | blood | 9606 | 641 |
| BRCA1 | Breast-ovarian cancer susceptibility, familial breast cancer | blood | 9606 | 672 |
| BRCA2 | Breast-ovarian cancer susceptibility, familial breast cancer, glioma susceptibility | blood | 9606 | 675 |
| CASR (calcium sensing receptor) | Epilepsy susceptibility | blood | 9606 | 846 |
| CDC73 | Hyperparathyroidism 2 with jaw tumors | blood | 9606 | 79577 |
| CEBPA | Acute myeloid leukemia | blood | 9606 | 1050 |
| EPCAM | Colorectal cancer | blood | 9606 | 4072 |
| FH | hypercholesterolemia | blood | 9606 | 2271 |
| GATA2 | Acute myeloid leukemia | blood | 9606 | 2642 |
| MITF | Melanoma susceptibility | blood | 9606 | 4286 |
| MSH2 | Lynch syndrome | blood | 9606 | 4436 |
| MSH3 | Endometrial carcinoma | blood | 9606 | 4437 |
| MSH6 | Endometrial carcinoma, colorectal cancer | blood | 9606 | 2956 |
| NF1 | Neurofibromatosis, juvenile myelomonocytic leukemia | blood | 9606 | 4763 |
| PDGRA | Eosinophilic leukemia, recurrent inflammatory gastrointestinal fibroids | blood | 9606 | 5156 |
| PHOX2B | Neuroblastoma susceptibility | blood | 9606 | 8929 |
| POT1 | Melanoma susceptibility, glioma susceptibility | blood | 9606 | 25913 |

The target nucleic acids of interest may be taken from environmental samples. A list of exemplary biosafety pathogens is in Table 5, and an exemplary list of known viruses is in Table 6.

TABLE 5

Exemplary Laboratory Biosafety Parasites and Pathogens

| Name | Category | NCBI Taxonomy ID | Name | Category | NCBI Taxonomy ID |
| --- | --- | --- | --- | --- | --- |
| *Acarapis woodi* | Animal | 478375 | *Streptococcus uberis* | Bacteria | 1349 |
| *Aethina tumida* | Animal | 116153 | *Besnoitia besnoiti* | Chromista | 94643 |
| Alaria americana | Animal | 2282137 | *Bonamia exitiosa* | Chromista | 362532 |
| *Amblyomma americanum* | Animal | 6943 | *Bonamia ostreae* | Chromista | 126728 |
| *Amblyomma maculatum* | Animal | 34609 | *Amniculicola longissima* | Fungus | 2566060 |
| *Amphimerus pseudofelineus* | Animal | | *Arthroderma amazonicum* | Fungus | 1592210 |
| *Ancylostoma braziliense* | Animal | 369059 | *Aschersonia hypocreoidea* | Fungus | 370936 |
| *Ancylostoma caninum* | Animal | 29170 | *Aspergillago clavatoflava* | Fungus | 41064 |
| *Ancylostoma duodenale* | Animal | 51022 | *Aspergillus acidohumus* | Fungus | 1904037 |
| *Anisakis pegreffii* | Animal | 303229 | *Aspergillus acidus* | Fungus | 1069201 |
| *Anisakis simplex* | Animal | 6269 | *Aspergillus aculeatinus* | Fungus | 487661 |
| *Baylisascaris columnaris* | Animal | 575210 | *Aspergillus aculeatus* | Fungus | 5053 |
| *Baylisascaris melis* | Animal | | *Aspergillus aeneus* | Fungus | 41754 |
| *Baylisascaris procyonis* | Animal | 6259 | *Aspergillus affinis* | Fungus | 1070780 |
| *Bunostomum phlebotomum* | Animal | 577651 | *Aspergillus alabamensis* | Fungus | 657433 |
| *Ceratonova shasta* | Animal | 60662 | *Aspergillus alliaceus* | Fungus | 209559 |
| *Chrysomya bezziana* | Animal | 69364 | *Aspergillus amazonicus* | Fungus | 710228 |
| *Cochliomyia hominivorax* | Animal | 115425 | *Aspergillus ambiguus* | Fungus | 176160 |
| *Dicrocoelium dendriticum* | Animal | 57078 | *Aspergillus amoenus* | Fungus | 1220191 |
| *Diphyllobothrium dendriticum* | Animal | 28845 | *Aspergillus amyloliquefaciens* | Fungus | 296546 |
| *Diphyllobothrium latum* | Animal | 60516 | *Aspergillus amylovorus* | Fungus | 176161 |
| *Echinococcus granulosa* | Animal | | *Aspergillus angustatus* | Fungus | 2783700 |
| *Echinococcus multilocularis* | Animal | 6211 | *Aspergillus anomalus* | Fungus | 454240 |
| *Echinococcus oligarthrus* | Animal | 6212 | *Aspergillus anthodesmis* | Fungus | 37233 |
| *Echinococcus shiquicus* | Animal | 260967 | *Aspergillus apicalis* | Fungus | 478867 |
| *Echinococcus vogeli* | Animal | 6213 | *Aspergillus appendiculatus* | Fungus | 1140386 |
| *Echinostoma cinetorchis* | Animal | 1873862 | *Aspergillus arachidicola* | Fungus | 656916 |
| *Echinostoma hortense* | Animal | 48216 | *Aspergillus ardalensis* | Fungus | 1458899 |
| *Echinostoma liei* | Animal | 48214 | *Aspergillus arvii* | Fungus | 368784 |
| *Echinostoma revolutum* | Animal | 48217 | *Aspergillus askiburgiensis* | Fungus | 1695225 |
| *Fasciola hepatica* | Animal | 6192 | *Aspergillus asperescens* | Fungus | 176163 |
| *Fascioloides magna* | Animal | 394415 | *Aspergillus assulatus* | Fungus | 1245746 |
| *Gyrodactylus salaris* | Animal | 37629 | *Aspergillus astellatus* | Fungus | 1810904 |
| *Ixodes pacificus* | Animal | 29930 | *Aspergillus aurantiobrunneus* | Fungus | 41725 |
| *Ixodes ricinus* | Animal | 34613 | *Aspergillus aurantiopurpureus* | Fungus | 2663348 |
| *Ixodes scapularis* | Animal | 6945 | *Aspergillus aureolatus* | Fungus | 41755 |

TABLE 5-continued

Exemplary Laboratory Biosafety Parasites and Pathogens

| Name | Category | NCBI Taxonomy ID | Name | Category | NCBI Taxonomy ID |
|---|---|---|---|---|---|
| *Metagonimus yokogawai* | Animal | 84529 | *Aspergillus aureoterreus* | Fungus | 41288 |
| *Metorchis conjunctus* | Animal | | *Aspergillus aureus* | Fungus | 309747 |
| *Myxobolus cerebralis* | Animal | 59783 | *Aspergillus auricomus* | Fungus | 138274 |
| *Nanophyetus salmincola* | Animal | 240278 | *Aspergillus australiensis* | Fungus | 1250384 |
| *Necator americanus* | Animal | 51031 | *Aspergillus austroafricanus* | Fungus | 1220192 |
| *Oestrus ovis* | Animal | 123737 | *Aspergillus avenaceus* | Fungus | 36643 |
| *Opisthorchis felineus* | Animal | 147828 | *Aspergillus awamori* | Fungus | 105351 |
| *Opisthorchis viverrini* | Animal | 6198 | *Aspergillus baarnensis* | Fungus | 2070749 |
| *Parafilaria bovicola* | Animal | 2282233 | *Aspergillus baeticus* | Fungus | 1194636 |
| *Paragonimus kellicotti* | Animal | 100269 | *Aspergillus bahamensis* | Fungus | 522521 |
| *Paragonimus miyazakii,* | Animal | 59628 | *Aspergillus bertholletiae* | Fungus | 1226010 |
| *Paragonimus westermani* | Animal | 34504 | *Aspergillus biplanus* | Fungus | 176164 |
| *Psoroptes ovis* | Animal | 83912 | *Aspergillus bisporus* | Fungus | 41753 |
| *Rhipicephalus annulatus* | Animal | 34611 | *Aspergillus bombycis* | Fungus | 109264 |
| *Rhipicephalus sanguineus* | Animal | 34632 | *Aspergillus botswanensis* | Fungus | 1810893 |
| *Sarcoptes scabiei* | Animal | 52283 | *Candida albicans* | Fungus | 5476 |
| *Taenia multiceps* | Animal | 94034 | *Candida glabrata* | Fungus | 5478 |
| *Taenia saginata* | Animal | 6206 | *Candida krusei* | Fungus | 4909 |
| *Taenia solium* | Animal | 6204 | *Candida parapsilosis* | Fungus | 5480 |
| *Toxocara canis* | Animal | 6265 | *Candida tropicalis* | Fungus | 5482 |
| *Toxocara cati* | Animal | 6266 | *Cryptococcus gattii* | Fungus | 37769 |
| *Trichinella spiralis* | Animal | 6334 | *Cryptococcus neoformans* | Fungus | 5207 |
| *Trichuris suis* | Animal | 68888 | *Epidermophyton floccosum* | Fungus | 34391 |
| *Trichuris trichiura* | Animal | 36087 | *Epidermophyton stockdaleae* | Fungus | 74042 |
| *Trichuris vulpis* | Animal | 219738 | *Fusarium acaciae* | Fungus | |
| *Tropilaelaps clareae* | Animal | 208209 | *Fusarium acaciae-mearnsii* | Fungus | 282272 |
| *Tropilaelaps mercedesae* | Animal | 418985 | *Fusarium acicola* | Fungus | |
| *Uncinaria stenocephala* | Animal | 125367 | *Fusarium acremoniopsis* | Fungus | |
| *Varroa destructor* | Animal | 109461 | *Fusarium acridiorum* | Fungus | |
| *Actinobacillus pleuropneumoniae* | Bacteria | 715 | *Fusarium acutatum* | Fungus | 78861 |
| *Aeromonas hydrophila* | Bacteria | 644 | *Fusarium aderholdii* | Fungus | |
| *Aeromonas salmonicida* | Bacteria | 645 | *Fusarium adesmiae* | Fungus | |
| *Aliarcobacter butzleri* | Bacteria | 28197 | *Fusarium aduncisporum* | Fungus | |
| *Aliarcobacter cryaerophilus* | Bacteria | 28198 | *Fusarium aecidii-tussilaginis* | Fungus | |
| *Aliarcobacter skirrowii* | Bacteria | 28200 | *Fusarium aeruginosam* | Fungus | |
| *Anaplasma centrale* | Bacteria | 769 | *Fusarium aethiopicum* | Fungus | 569394 |
| *Anaplasma marginale* | Bacteria | 770 | *Fusarium affine* | Fungus | |
| *Anaplasma phagocytophilum* | Bacteria | 948 | *Fusarium agaricorum* | Fungus | |
| *Bacillus anthracis* | Bacteria | 1392 | *Fusarium rilailanthinum* | Fungus | |

TABLE 5-continued

Exemplary Laboratory Biosafety Parasites and Pathogens

| Name | Category | NCBI Taxonomy ID | Name | Category | NCBI Taxonomy ID |
|---|---|---|---|---|---|
| *Bacillus cereus* | Bacteria | 1396 | *Fusarium alabamense* | Fungus | |
| *Bartonella henselae* | Bacteria | 38323 | *Fusarium albedinis* | Fungus | |
| *Bibersteinia trehalosi* | Bacteria | 47735 | *Fusarium albertii* | Fungus | |
| *Borrelia burgdorferi* | Bacteria | 139 | *Fusarium albidoviolaceum* | Fungus | |
| *Brucella abortus* | Bacteria | 235 | *Fusarium albiziae* | Fungus | |
| *Brucella canis* | Bacteria | 36855 | *Fusarium albocarneum* | Fungus | |
| *Brucella melitensis* | Bacteria | 29459 | *Fusarium album* | Fungus | |
| *Brucella ovis* | Bacteria | 236 | *Fusarium aleurinum* | Fungus | |
| *Brucella suis* | Bacteria | 29461 | *Fusarium aleyrodis* | Fungus | |
| *Burkholderia mallei* | Bacteria | 13373 | *Fusarium alkanophilum* | Fungus | |
| *Burkholderia pseudomallei* | Bacteria | 28450 | *Fusarium allescheri* | Fungus | |
| *Campylobacter coli* | Bacteria | 195 | *Fusarium allescherianum* | Fungus | |
| *Campylobacter fetus fetus* | Bacteria | 32019 | *Fusarium allii-sativi* | Fungus | |
| *Campylobacter fetus venerealis* | Bacteria | 32020 | *Trichophyton simii* | Fungus | 63406 |
| *Campylobacter jejuni* | Bacteria | 197 | *Trichophyton soudanense* | Fungus | 69891 |
| *Chlamydia caviae* | Bacteria | 83557 | *Trichophyton tonsurans* | Fungus | 34387 |
| *Chlamydia felis* | Bacteria | 83556 | *Trichophyton verrucosum* | Fungus | 63417 |
| *Chlamydia muridarum* | Bacteria | 83560 | *Trichophyton violaceum* | Fungus | 34388 |
| *Chlamydia pecorum* | Bacteria | 85991 | *Ochroma pyramidale* | Plant | 66662 |
| *Chlamydia pneumoniae* | Bacteria | 83558 | *Babesia bigemina* | Protozoa | 5866 |
| *Chlamydia psittaci* | Bacteria | 83554 | *Babesia bovis* | Protozoa | 5865 |
| *Chlamydia suis* | Bacteria | 83559 | *Babesia divergens* | Protozoa | 32595 |
| *Chlamydia trachomatis* | Bacteria | 813 | *Babesia jakimovi* | Protozoa | |
| *Chlamydophilus abortus* | Bacteria | | *Babesia major* | Protozoa | 127461 |
| *Clostridium botulinum* | Bacteria | 1491 | *Babesia occultans* | Protozoa | 536930 |
| *Clostridium difficile* | Bacteria | 1496 | *Babesia ovata* | Protozoa | 189622 |
| *Clostridium perfringens* Types A, B, C, and D | Bacteria | | *Cryptosporidium parvum* | Protozoa | 5807 |
| *Coxiella burnetii* | Bacteria | 777 | *Eimeria acervulina* | Protozoa | 5801 |
| *Cronobacter sakazakii* | Bacteria | 28141 | *Eimeria brunetti* | Protozoa | 51314 |
| *Ehrlichia canis* | Bacteria | 944 | *Eimeria maxima* | Protozoa | 5804 |
| *Ehrlichia chaffeensis* | Bacteria | 945 | *Eimeria meleagridis* | Protozoa | 1431345 |
| *Ehrlichia ewingii* | Bacteria | 947 | *Eimeria necatrix* | Protozoa | 51315 |
| *Ehrlichia ondiri* | Bacteria | | *Eimeria tenella* | Protozoa | 5802 |
| *Ehrlichia ruminantium* | Bacteria | 779 | *Entamoeba histolytica* | Protozoa | 5759 |
| *Escherichia coli* | Bacteria | 562 | *Giardia duodenalis* | Protozoa | 5741 |
| *Klebsiella aerogenes* | Bacteria | 548 | *Giardia lambia* | Protozoa | |
| *Klebsiella granulomatis* | Bacteria | 39824 | *Histomonas meleagridis* | Protozoa | 135588 |
| *Klebsiella grimontii* | Bacteria | 2058152 | *Ichthyobodo necator* | Protozoa | 155203 |
| *Klebsiella huaxiensis* | Bacteria | 2153354 | *Ichthyophthirius multifiliis* | Protozoa | 5932 |
| *Klebsiella kielensis* | Bacteria | 2042302 | *Isospora burrowsi* | Protozoa | |

TABLE 5-continued

Exemplary Laboratory Biosafety Parasites and Pathogens

| Name | Category | NCBI Taxonomy ID | Name | Category | NCBI Taxonomy ID |
|---|---|---|---|---|---|
| Klebsiella michiganensis | Bacteria | 1134687 | Isospora canis | Protozoa | 1662860 |
| Klebsiella milletis | Bacteria | 223378 | Isospora felis | Protozoa | 482539 |
| Klebsiella oxytoca | Bacteria | 571 | Isospora neorivolta | Protozoa | |
| Klebsiella pneumoniae | Bacteria | 573 | Isospora ohioensis | Protozoa | 279926 |
| Klebsiella quasipneumoniae | Bacteria | 1463165 | Leishmania braziliensis | Protozoa | 5660 |
| Klebsiella quasivariicola | Bacteria | 2026240 | Leishmania chagasi | Protozoa | 44271 |
| Klebsiella senegalensis | Bacteria | 223379 | Leishmania infantum | Protozoa | 5671 |
| Klebsiella steroids | Bacteria | 1641362 | Marteilia refringens | Protozoa | 107386 |
| Klebsiella variicola | Bacteria | 244366 | Mikrocytos mackini | Protozoa | 195010 |
| Proteus mirabilis | Bacteria | 584 | Perkinsus marinus | Protozoa | 31276 |
| Pseudomonas abietaniphila | Bacteria | 89065 | Perkinsus olensi | Protozoa | |
| Pseudomonas acephalitica | Bacteria | 407029 | Sarcocystis cruzi | Protozoa | 5817 |
| Pseudomonas acidophila | Bacteria | 1912599 | Sarcocystis hirsuta | Protozoa | 61649 |
| Pseudomonas adelgestsugas | Bacteria | 1302376 | Sarcocystis hominis | Protozoa | 61650 |
| Pseudomonas aeruginosa | Bacteria | 287 | Theileria annulata | Protozoa | 5874 |
| Pseudomonas aestus | Bacteria | 1387231 | Theileria buffei | Protozoa | |
| Pseudomonas agarici | Bacteria | 46677 | Theileria lestoquardi | Protozoa | 77054 |
| Pseudomonas akappageensis | Bacteria | | Theileria luwenshuni | Protozoa | 540482 |
| Pseudomonas alcaligenes | Bacteria | 43263 | Theileria mutans | Protozoa | 27991 |
| Pseudomonas alcaliphila | Bacteria | 101564 | Theileria orientalis | Protozoa | 68886 |
| Pseudomonas alginovora | Bacteria | 37638 | Theileria parva | Protozoa | 5875 |
| Pseudomonas alkanolytica | Bacteria | | Theileria sergenti | Protozoa | 5877 |
| Pseudomonas alkylphenolica | Bacteria | 237609 | Theileria uilenbergi | Protozoa | 507731 |
| Pseudomonas allii | Bacteria | 2740531 | Toxoplasma gondii | Protozoa | 5811 |
| Pseudomonas alliivorans | Bacteria | 2810613 | Trichomonas fetus | Protozoa | |
| Pseudomonas allokribbensis | Bacteria | 2774460 | Trichomonas gallinae | Protozoa | 56777 |
| Pseudomonas alloputida | Bacteria | 1940621 | Trichomonas stableri | Protozoa | 1440121 |
| Pseudomonas alvandae | Bacteria | 2842348 | Trypanosoma brucei | Protozoa | 5691 |
| Pseudomonas amygdali | Bacteria | 47877 | Trypanosoma congolense | Protozoa | 5692 |
| Pseudomonas amyloderamosa | Bacteria | 32043 | Trypanosoma cruzi | Protozoa | 5693 |
| Pseudomonas anatoliensis | Bacteria | 2710589 | Abras virus | Virus | 2303487 |
| Pseudomonas andersonii | Bacteria | 147728 | Absettarov virus | Virus | |
| Pseudomonas anguilliseptica | Bacteria | 53406 | Abu Hammad virus | Virus | 248058 |
| Pseudomonas antarctica | Bacteria | 219572 | Abu Mina virus | Virus | 248059 |
| Pseudomonas anuradhapurensis | Bacteria | 485870 | Acado virus | Virus | |
| Pseudomonas arcuscaelestis | Bacteria | 2710591 | Acara virus | Virus | 2748201 |
| Pseudomonas argentinensis | Bacteria | 289370 | Achiote virus | Virus | 2036702 |

TABLE 5-continued

Exemplary Laboratory Biosafety Parasites and Pathogens

| Name | Category | NCBI Taxonomy ID | Name | Category | NCBI Taxonomy ID |
|---|---|---|---|---|---|
| *Pseudomonas arsenicoxydans* | Bacteria | 702115 | *Adana virus* | Virus | 1611877 |
| *Pseudomonas asgharzadehiana* | Bacteria | 2842349 | *Adelaide River virus* | Virus | 31612 |
| *Pseudomonas asiatica* | Bacteria | 2219225 | *Adria virus* | Virus | |
| *Pseudomonas asplenii* | Bacteria | 53407 | *Aedes aegypti densovirus* | Virus | 186156 |
| *Pseudomonas asturiensis* | Bacteria | 1190415 | *Aedes albopictus densovirus* | Virus | 35338 |
| *Pseudomonas asuensis* | Bacteria | 1825787 | *Aedes flavivirus* | Virus | 390845 |
| *Pseudomonas atacamensis* | Bacteria | 2565368 | *Aedes galloisi flavivirus* | Virus | 1046551 |
| *Pseudomonas atagonensis* | Bacteria | 2609964 | *Aedes pseudoscutellaris densovirus* | Virus | |
| *Pseudomonas aurantiaca* | Bacteria | 86192 | *Aedes pseudoscutellaris reovirus* | Virus | 341721 |
| *Pseudomonas aureofaciens* | Bacteria | 587851 | *Aedes vexans* | Virus | 7163 |
| *Pseudomonas avellanae* | Bacteria | 46257 | African horse sickness virus | Virus | 40050 |
| *Pseudomonas aylmerensis* | Bacteria | 1869229 | African swine fever virus | Virus | 10497 |
| *Pseudomonas azadiae* | Bacteria | 2843612 | *Aguacate virus* | Virus | 1006583 |
| *Pseudomonas azerbaijanoccidentalis* | Bacteria | | *Aino virus* | Virus | 11582 |
| *Pseudomonas azerbaijanorientalis* | Bacteria | | *Akabane virus* | Virus | 70566 |
| *Pseudomonas azotifigens* | Bacteria | 291995 | *Alajuela virus* | Virus | 1552846 |
| *Pseudomonas azotoformans* | Bacteria | 47878 | *Alcelaphine gammaherpesvirus 1* | Virus | 35252 |
| *Pseudomonas baetica* | Bacteria | 674054 | *Alenquer virus* | Virus | 629726 |
| *Pseudomonas balearica* | Bacteria | 74829 | Aleutian Mink Disease | Virus | |
| *Pseudomonas baltica* | Bacteria | 2762576 | *Alfuy virus* | Virus | 44017 |
| *Pseudomonas bananamidigenes* | Bacteria | 2843610 | Alkhumra hemorrhagic fever virus | Virus | 172148 |
| *Pseudomonas bathycetes* | Bacteria | | *Allpahuayo mammarenavirus* | Virus | 144752 |
| *Pseudomonas batumici* | Bacteria | 226910 | *Almeirim virus* | Virus | |
| *Pseudomonas benzenivorans* | Bacteria | 556533 | *Almendravirus arboretum* | Virus | 1972683 |
| *Pseudomonas bijieensis* | Bacteria | 2681983 | *Almendravirus cootbay* | Virus | 1972685 |
| *Pseudomonas blatchfordae* | Bacteria | 254015 | *Almpiwar virus* | Virus | 318843 |
| *Pseudomonas bohemica* | Bacteria | 2044872 | *Alocasia macrorrhizos* | Virus | 4456 |
| *Pseudomonas borbori* | Bacteria | 289003 | *Altamira virus* | Virus | |
| *Pseudomonas borealis* | Bacteria | 84586 | *Amapari virus* | Virus | |
| *Pseudomonas botevensis* | Bacteria | 2842352 | *Ambe virus* | Virus | 1926500 |
| *Pseudomonas brassicacearum* | Bacteria | 930166 | *Amga virus* | Virus | 1511732 |
| *Pseudomonas brassicae* | Bacteria | 2708063 | *Amur/Soochong virus* | Virus | |
| *Pseudomonas brenneri* | Bacteria | 129817 | *Anadyr virus* | Virus | 1642852 |
| *Pseudomonas bubulae* | Bacteria | 2316085 | *Anajatuba virus* | Virus | 379964 |

TABLE 5-continued

Exemplary Laboratory Biosafety Parasites and Pathogens

| Name | Category | NCBI Taxonomy ID | Name | Category | NCBI Taxonomy ID |
|---|---|---|---|---|---|
| Pseudomonas campi | Bacteria | 2731681 | Ananindeua virus | Virus | 1927813 |
| Pseudomonas canadensis | Bacteria | 915099 | Andasibe virus | Virus | |
| Pseudomonas canavaninivorans | Bacteria | 2859001 | Andes orthohantavirus | Virus | 1980456 |
| Pseudomonas cannabina | Bacteria | 86840 | Anhanga virus | Virus | 904722 |
| Pseudomonas capeferrum | Bacteria | 1495066 | Anhembi virus | Virus | 273355 |
| Pseudomonas capsici | Bacteria | 2810614 | Anopheles A virus | Virus | 35307 |
| Pseudomonas caricapapayae | Bacteria | 46678 | Anopheles B virus | Virus | 35308 |
| Pseudomonas carnis | Bacteria | 2487355 | Anopheles flavivirus | Virus | 2053814 |
| Pseudomonas caspiana | Bacteria | 1451454 | Anopheles gambiae densovirus | Virus | 487311 |
| Pseudomonas cavernae | Bacteria | 2320867 | Antequera virus | Virus | 2748239 |
| Pseudomonas cavernicola | Bacteria | 2320866 | Apoi virus | Virus | 64280 |
| Pseudomonas cedrina | Bacteria | 651740 | Araguari virus | Virus | 352236 |
| Pseudomonas cellulosa | Bacteria | 155077 | Aransas Bay virus | Virus | 1428582 |
| Pseudomonas cerasi | Bacteria | 1583341 | Araraquara Virus | Virus | 139032 |
| Pseudomonas chaetocerotis | Bacteria | | Bluetongue virus | Virus | 40051 |
| Pseudomonas chengduensis | Bacteria | 489632 | Bobaya virus | Virus | 2818228 |
| Pseudomonas chloritidismutans | Bacteria | 203192 | Bobia virus | Virus | |
| Pseudomonas chlororaphis | Bacteria | 587753 | Boraceia virus | Virus | |
| Pseudomonas cichorii | Bacteria | 36746 | Borna disease virus | Virus | 12455 |
| Pseudomonas citronellolis | Bacteria | 53408 | Botambi virus | Virus | |
| Pseudomonas clemancea | Bacteria | 416340 | Boteke virus | Virus | 864698 |
| Pseudomonas coenobios | Bacteria | | Bouboui virus | Virus | 64295 |
| Pseudomonas coleopterorum | Bacteria | 1605838 | Bourbon virus | Virus | 1618189 |
| Pseudomonas composti | Bacteria | 658457 | Bovine ephemeral fever virus | Virus | 11303 |
| Pseudomonas congelans | Bacteria | 200452 | Bovine Herpes Virus 1 | Virus | |
| Pseudomonas coronafaciens | Bacteria | 53409 | Bovine leukemia virus | Virus | 11901 |
| Pseudomonas corrugata | Bacteria | 47879 | Bovine orthopneumovirus | Virus | 11246 |
| Pseudomonas costantinii | Bacteria | 168469 | Bovine viral diarrhea virus 1 | Virus | 11099 |
| Pseudomonas cremoricolorata | Bacteria | 157783 | Bowe virus | Virus | 1400425 |
| Pseudomonas cremoris | Bacteria | 2724178 | Bozo virus | Virus | 273349 |
| Pseudomonas crudilactis | Bacteria | 2697028 | Cumuto virus | Virus | 1457166 |
| Pseudomonas cuatrocienegasensis | Bacteria | 543360 | Cupixi mammarenavirus | Virus | 208899 |
| Pseudomonas cyclaminis | Bacteria | 2781239 | Curionopolis virus | Virus | 490110 |
| Pseudomonas daroniae | Bacteria | 2487519 | Cyprinid herpesvirus 3 | Virus | 180230 |
| Pseudomonas deceptionensis | Bacteria | 882211 | Czech Aedes vexans flavivirus virus | Virus | |
| Pseudomonas defluvii | Bacteria | 1876757 | D' Aguilar virus | Virus | |

TABLE 5-continued

Exemplary Laboratory Biosafety Parasites and Pathogens

| Name | Category | NCBI Taxonomy ID | Name | Category | NCBI Taxonomy ID |
|---|---|---|---|---|---|
| Pseudomonas delhiensis | Bacteria | 366289 | Dabakala virus | Virus | |
| Pseudomonas denitrificans | Bacteria | 43306 | Dabieshan virus | Virus | 1167310 |
| Pseudomonas diazotrophicus | Bacteria | | Dak Nong virus | Virus | 1238455 |
| Pseudomonas diterpeniphila | Bacteria | 135830 | Dakar bat virus | Virus | 64282 |
| Pseudomonas donghuensis | Bacteria | 1163398 | Dandenong virus | Virus | 483046 |
| Pseudomonas dryadis | Bacteria | 2487520 | Dashli virus | Virus | 1764087 |
| Pseudomonas duriflava | Bacteria | 459528 | Deer tick virus | Virus | 58535 |
| Pseudomonas edaphica | Bacteria | 2006980 | Dengue virus | Virus | 12637 |
| Pseudomonas ekonensis | Bacteria | 2842353 | Dengue virus 1 virus | Virus | |
| Pseudomonas elodea | Bacteria | 179878 | Cumuto virus | Virus | 1457166 |
| Pseudomonas endophytica | Bacteria | 1563157 | Cupixi mammarenavirus | Virus | 208899 |
| Pseudomonas entomophila | Bacteria | 312306 | Curionopolis virus | Virus | 490110 |
| Pseudomonas eucalypticola | Bacteria | 2599595 | Lymphocytic choriomeningitis mammarenavirus | Virus | 11623 |
| Pseudomonas excibis | Bacteria | | Lyssavirus aravan | Virus | 211977 |
| Pseudomonas extremaustralis | Bacteria | 359110 | Lyssavirus australis | Virus | 90961 |
| Pseudomonas extremorientalis | Bacteria | 169669 | Lyssavirus lagos | Virus | 38766 |
| Pseudomonas fakonensis | Bacteria | 2842355 | Lyssavirus spp. | Virus | 11286 |
| Pseudomonas farris | Bacteria | 2841207 | Lyssavirus bokeloh | Virus | 1072176 |
| Pseudomonas farsensis | Bacteria | 2745492 | Lyssavirus caucasicus | Virus | 249584 |
| Pseudomonas ficuserectae | Bacteria | 53410 | Lyssavirus duvenhage | Virus | 38767 |
| Pseudomonas fildesensis | Bacteria | 1674920 | Lyssavirus irkut | Virus | 249583 |
| Pseudomonas flavescens | Bacteria | 29435 | Lyssavirus khujand | Virus | 237716 |
| Pseudomonas flexibilis | Bacteria | 706570 | Lyssavirus mokola | Virus | 12538 |
| Pseudomonas floridensis | Bacteria | 1958950 | Lyssavirus rabies | Virus | 11292 |
| Pseudomonas fluorescens | Bacteria | 294 | Lyssavirus shimoni | Virus | 746543 |
| Pseudomonas fluvialis | Bacteria | 1793966 | Marisma mosquito virus | Virus | 1105173 |
| Pseudomonas foliumensis | Bacteria | 2762593 | Marituba virus | Virus | 292278 |
| Pseudomonas fragi | Bacteria | 296 | Marondera virus | Virus | 108092 |
| Pseudomonas frederiksbergensis | Bacteria | 104087 | Marrakai virus | Virus | 108088 |
| Pseudomonas fulgida | Bacteria | 200453 | Massila virus | Virus | |
| Pseudomonas fulva | Bacteria | 47880 | Matariya virus | Virus | 1272948 |
| Pseudomonas furukawaii | Bacteria | 1149133 | Matruh virus | Virus | 1678229 |
| Pseudomonas fuscovaginae | Bacteria | 50340 | Matucare virus | Virus | 908873 |
| Pseudomonas gelidicola | Bacteria | 1653853 | Mayaro virus | Virus | 59301 |
| Pseudomonas gessardii | Bacteria | 78544 | Mboke virus | Virus | 273342 |
| Pseudomonas gingeri | Bacteria | 117681 | Mburo virus | Virus | 2035534 |

TABLE 5-continued

Exemplary Laboratory Biosafety Parasites and Pathogens

| Name | Category | NCBI Taxonomy ID | Name | Category | NCBI Taxonomy ID |
|---|---|---|---|---|---|
| *Pseudomonas glareae* | Bacteria | 1577705 | *Meaban virus* | Virus | 35279 |
| *Pseudomonas glycinae* | Bacteria | 1785145 | *Medjerda Valley virus* | Virus | 1775957 |
| *Pseudomonas gozinkensis* | Bacteria | 2774461 | *Melao virus* | Virus | 35515 |
| *Pseudomonas graminis* | Bacteria | 158627 | *Meno virus* | Virus | |
| *Pseudomonas granadensis* | Bacteria | 1421430 | *Mercadeo virus* | Virus | 1708574 |
| *Pseudomonas gregormendelii* | Bacteria | 1628277 | *Semliki Forest virus* | Virus | 11033 |
| *Pseudomonas grimontii* | Bacteria | 129847 | *Sena Madureira virus* | Virus | 1272957 |
| *aPseudomonas guangdongensis* | Bacteria | 1245526 | *Seoul virus* | Virus | 1980490 |
| *Pseudomonas guariconensis* | Bacteria | 1288410 | *Sepik virus* | Virus | 44026 |
| *Pseudomonas guezennei* | Bacteria | 310348 | *Serra Do Navio virus* | Virus | 45768 |
| *Pseudomonas guguanensis* | Bacteria | 1198456 | *Serra Norte virus* | Virus | 1000649 |
| *Pseudomonas guineae* | Bacteria | 425504 | Severe fever with thrombocytopenia syndrome virus | Virus | 1003835 |
| *Pseudomonas guryensis* | Bacteria | 2759165 | *Shamonda virus* | Virus | 159150 |
| *Pseudomonas haemolytica* | Bacteria | 2600065 | Shark River virus | Virus | 2303490 |
| *Pseudomonas halodenitrificans* | Bacteria | 53411 | Shiant Island virus | Virus | |
| *Pseudomonas halodurans* | Bacteria | 28258 | *Shokwe virus* | Virus | 273359 |
| *Pseudomonas halosaccharolytica* | Bacteria | | *Shuni virus* | Virus | 159148 |
| *Pseudomonas halosensibilis* | Bacteria | | *Silverwater virus* | Virus | 1564099 |
| *Pseudomonas hamedanensis* | Bacteria | 2745504 | *Simbu orthobunyavirus* | Virus | 35306 |
| *Pseudomonas helianthi* | Bacteria | 251654 | *Sin Nombre virus* | Virus | 1980491 |
| *Pseudomonas helleri* | Bacteria | 1608996 | *Sindbis virus* | Virus | 11034 |
| *Pseudomonas helmanticensis* | Bacteria | 1471381 | Sixgun City virus | Virus | |
| *Pseudomonas huaxiensis* | Bacteria | 2213017 | Skinner Tank virus | Virus | 481886 |
| *Pseudomonas hunanensis* | Bacteria | 1247546 | Snowshoe hare virus | Virus | 11580 |
| *Pseudomonas hutmensis* | Bacteria | 2707027 | *Sokoluk virus* | Virus | 64317 |
| *Pseudomonas hydrogenothermophila* | Bacteria | 297 | *Soldado virus* | Virus | 426791 |
| *Pseudomonas hydrogenovora* | Bacteria | 39439 | *Solwezi virus* | Virus | |
| *Pseudomonas hydrolytica* | Bacteria | 2493633 | *Somone virus* | Virus | |
| *Pseudomonas indica* | Bacteria | 137658 | *Sororoca virus* | Virus | 273354 |
| *Pseudomonas indoloxydans* | Bacteria | 404407 | *Souris virus* | Virus | 2010246 |
| *Pseudomonas inefficax* | Bacteria | 2078786 | South Bay virus | Virus | 1526514 |
| *Pseudomonas iranensis* | Bacteria | 2745503 | South River virus | Virus | 45769 |
| *Pseudomonas iridis* | Bacteria | 2710587 | *Spanish Culex flavivirus virus* | Virus | |
| *Pseudomonas izuensis* | Bacteria | 2684212 | *Spanish Ochlerotatus flavivirus virus* | Virus | |
| *Pseudomonas japonica* | Bacteria | 256466 | *Spondweni virus* | Virus | 64318 |

TABLE 5-continued

Exemplary Laboratory Biosafety Parasites and Pathogens

| Name | Category | NCBI Taxonomy ID | Name | Category | NCBI Taxonomy ID |
|---|---|---|---|---|---|
| *Pseudomonas jessenii* | Bacteria | 77298 | *Sprivirus cyprinus* | Virus | 696863 |
| *Pseudomonas jinanensis* | Bacteria | | *Sripur virus* | Virus | 1620897 |
| *Pseudomonas jinjuensis* | Bacteria | 198616 | St. Abbs Head virus | Virus | |
| *Pseudomonas juntendi* | Bacteria | 2666183 | St. Croix River virus | Virus | |
| *Pseudomonas kairouanensis* | Bacteria | 2293832 | St. Louis encephalitis virus | Virus | 11080 |
| *Pseudomonas karstica* | Bacteria | 1055468 | *Stanfield virus* | Virus | |
| *Pseudomonas kermanshahensis* | Bacteria | 2745482 | *Stratford virus* | Virus | 44027 |

TABLE 6

Exemplary list of viruses

| Name | NCBI Taxonomy ID | Name | NCBI Taxonomy ID | Name | NCBI Taxonomy ID |
|---|---|---|---|---|---|
| *Aalivirus A* | 2169685 | Enterovirus A | 138948 | *Pseudomonas virus Yua* | 462590 |
| *Aarhusvirus dagda* | 2732762 | Enterovirus B | 138949 | *Pseudoplusia includens virus* | |
| *Aarhusvirus katbat* | 2732763 | Enterovirus C | 138950 | *Pseudotevenvirus RB16* | 329381 |
| *Aarhusvirus luksen* | 2732764 | Enterovirus D | 138951 | *Pseudotevenvirus RB43* | 115991 |
| *Aarhusvirus mysterion* | 2732765 | Enterovirus E | 12064 | *Psimunavirus psiM2* | 2734265 |
| *Abaca bunchy top virus* | 438782 | Enterovirus F | 1330520 | *Psipapillomavirus 1* | 1177762 |
| *Abatino macacapox virus* | 2734574 | Enterovirus G | 106966 | *Psipapillomavirus 2* | 2170170 |
| *Abbeymikolonvirus abbeymikolon* | 2734213 | Enterovirus H | 310907 | *Psipapillomavirus 3* | 2170171 |
| *Abouovirus abouo* | 1984774 | Enterovirus I | 2040663 | *Psittacid alphaherpesvirus 1* | 50294 |
| *Abouovirus davies* | 1984775 | Enterovirus J | 1330521 | *Psittacine atadenovirus A* | 2003673 |
| *Abutilon golden mosaic virus* | 1926117 | Enterovirus K | 2169884 | *Psittacine aviadenovirus B* | 2169709 |
| *Abutilon mosaic Bolivia virus* | 932071 | Enterovirus L | 2169885 | *Psittacine aviadenovirus C* | 2734577 |
| *Abutilon mosaic Brazil virus* | 1046572 | *Entmonagintavirus ENT90* | 2734061 | *Psittacinepox virus* | 2169712 |
| *Abutilon mosaic virus* | 10815 | *Entoleuca entovirus* | 2734428 | *Pteridovirus filicis* | 2734351 |
| *Abutilon yellows virus* | 169102 | *Enytus montanus ichnovirus* | | *Pteridovirus maydis* | 2734352 |
| *Acadevirus PM116* | 2733576 | *Ephemerovirus adelaide* | 1972589 | *Pteropodid alphaherpesvirus 1* | 2560693 |
| *Acadevirus Pm5460* | 2733577 | *Ephemerovirus berrimah* | 1972594 | *Pteropox virus* | 1873698 |
| *Acadevirus PM85* | 2733574 | *Ephemerovirus febris* | 1972593 | *Pteropus associated gemycircularvirus 1* | 1985395 |

TABLE 6-continued

Exemplary list of viruses

| Name | NCBI Taxonomy ID | Name | NCBI Taxonomy ID | Name | NCBI Taxonomy ID |
|---|---|---|---|---|---|
| *Acadevirus* PM93 | 2733575 | *Ephemerovirus kimberley* | 1972595 | *Pteropus associated gemycircularvirus 10* | 1985404 |
| *Acadianvirus acadian* | 1982901 | *Ephemerovirus koolpinyah* | 1972596 | *Ptyasnivirus 1* | 2734501 |
| *Acadianvirus baee* | 1982902 | *Ephemerovirus kotonkan* | 1972587 | *Pukovnikvirus pukovnik* | 540068 |
| *Acadianvirus reprobate* | 1982903 | *Ephemerovirus obodhiang* | 1972592 | *Pulverervirus PFR1* | 2170091 |
| *Acanthamoeba polyphaga mimivirus* | 212035 | *Ephemerovirus yata* | 1972597 | *Puma lentivirus* | 12804 |
| *Acanthocystis turfacea chlorella virus 1* | 322019 | *Epichloe festucae virus 1* | 382962 | *Pumpkin polerovirus* | 2518373 |
| *Acara orthobunyavirus* | 2170053 | *Epinotia aporema granulovirus* | 166056 | *Pumpkin yellow mosaic virus* | 1410062 |
| *Achimota pararubulavirus 1* | 2560259 | *Epiphyas postvittana nucleopolyhedrovirus* | 70600 | *Punavirus P1* | 10678 |
| *Achimota pararubulavirus 2* | 2560260 | *Epirus cherry virus* | 544686 | *Punavirus RCS47* | 2560452 |
| *Achromobacter virus* Axp3 | 2169962 | *Epizootic haematopoietic necrosis virus* | 100217 | *Punavirus SJ46* | 2560732 |
| *Acidianus bottle-shaped virus* | 437444 | *Epizootic hemorrhagic disease virus* | 40054 | *Punique phlebovirus* | 2734468 |
| *Acidianus filamentous virus 2* | 300186 | *Eponavirus epona* | 2734105 | *Punta Toro phlebovirus* | 1933186 |
| *Acidianus filamentous virus 3* | 346881 | *Epseptimavirus 118970sal2* | 1982565 | *Puumala orthohantavirus* | 1980486 |
| *Acidianus filamentous virus 6* | 346882 | *Epseptimavirus EPS7* | 491003 | *Pyrobaculum filamentous virus 1* | 1805492 |
| *Acidianus filamentous virus 7* | 346883 | *Epseptimavirus ev123* | 2732021 | *Pyrobaculum spherical virus* | 270161 |
| *Acidianus filamentous virus 8* | 346884 | *Epseptimavirus* | 2732022 | *Qadamvirus SB28* | 2733953 |
| *Acidianus filamentous virus 9* | 512792 | *Epseptimavirus LVR16A* | 2732023 | *Qalyub orthonairovirus* | 1980527 |
| *Acidianus rod-shaped virus 1* | 309181 | *Epseptimavirus mar003J3* | 2732019 | *Qingdaovirus J21* | 2734135 |
| *Acidianus spindle-shaped virus 1* | 693629 | *Epseptimavirus S113* | 2732024 | *Qingling orthophasmavirus* | 2560694 |
| *Acidianus two-tailed virus* | 315953 | *Epseptimavirus S114* | 2732025 | *Quail pea mosaic virus* | |
| *Acinetobacter virus 133* | 279006 | *Epseptimavirus S116* | 2732026 | *Quailpox virus* | 400570 |
| *Acintetobacter virus B2* | | *Epseptimavirus S124* | 2732027 | *Quaranjavirus johnstonense* | 688437 |
| *Acintetobacter virus B5* | | *Epseptimavirus S126* | 2732028 | *Quaranjavirus quaranfilense* | 688436 |
| *Acionnavirus monteraybay* | 2734078 | *Epseptimavirus S132* | 2732029 | *Qubevirus durum* | 39803 |
| *Acipenserid herpesvirus 2* | 2871198 | *Epseptimavirus S133* | 2732030 | *Qubevirus faecium* | 39804 |
| *Aconitum latent virus* | 101764 | *Epseptimavirus S147* | 2732031 | *Quezon mobatvirus* | 2501382 |

TABLE 6-continued

Exemplary list of viruses

| Name | NCBI Taxonomy ID | Name | NCBI Taxonomy ID | Name | NCBI Taxonomy ID |
|---|---|---|---|---|---|
| *Acrobasis zelleri entomopoxvirus* | | *Epseptimavirus saus 132* | 2732020 | *Quhwahvirus kaihaidragon* | 2283289 |
| *Actinidia seed borne latent virus* | 2560282 | *Epseptimavirus seafire* | 2732032 | *Quhwahvirus ouhwah* | 2201441 |
| *Actinidia virus 1* | 2024724 | *Epseptimavirus SH9* | 2732033 | *Quhwahvirus paschalis* | 2182400 |
| *Actinidia virus A* | 1112769 | *Epseptimavirus STG2* | 2732034 | *Rabbit associated gemykroznavirus 1* | 1985420 |
| *Actinidia virus B* | 1112770 | *Epseptimavirus stitch* | 1540099 | *Rabbit fibroma virus* | 10271 |
| *Actinidia virus X* | 1331744 | *Epseptimavirus Sw2* | 2732035 | *Rabbit hemorrhagic disease virus* | 11976 |
| *Acute bee paralysis virus* | 92444 | *Epsilonarterivirus hemcep* | 2501964 | *Rabovirus A* | 1603962 |
| *Adana phlebovirus* | 2734433 | *Epsilonarterivirus safriver* | 2501965 | *Rabovirus B* | 2560695 |
| *Adeno-associated dependoparvo virus A* | 1511891 | *Epsilonarterivirus zamalb* | 2501966 | *Rabovirus C* | 2560696 |
| *Adeno-associated dependoparvo virus B* | 1511892 | *Epsilonpapillo mavirus 1* | 40537 | *Rabovirus D* | 2560697 |
| *Adoxophyes honmai entomopoxvirus* | 1993630 | *Epsilonpapillo mavirus 2* | 2169886 | *Raccoonpox virus* | 10256 |
| *Adoxophyes honmai nucleopolyhed rovirus* | 224399 | *Epsilonpolyo mavirus bovis* | 1891754 | *Radish leaf curl virus* | 435646 |
| *Adoxophyes orana granulovirus* | 170617 | *Eptesipox virus* | 1329402 | *Radish mosaic virus* | 328061 |
| *Aedes aegypti entomopoxvirus* | | *Equid alphaherpesvirus 1* | 10326 | *Radish yellow edge virus* | 319460 |
| *Aedes aegypti Mosqcopia virus* | | *Equid alphaherpesvirus 3* | 80341 | *Rafivirus A* | |
| *Aedes pseudoscutella ris reovirus* | 341721 | *Equid alphaherpesvirus 4* | 10331 | *Rafivirus B* | 2560699 |
| *Aegirvirus SCBP42* | 2733888 | *Equid alphaherpesvirus 8* | 39637 | *Rafivirus C* | |
| *Aeonium ringspot virus* | 1962503 | *Equid alphaherpesvirus 9* | 55744 | *Raleighvirus darolandstone* | 2734266 |
| *Aeromonas virus 43* | | *Equid gammaherpes virus 2* | 12657 | *Raleighvirus raleigh* | 2734267 |
| *Aeropyrum coil-shaped virus* | 1157339 | *Equid gammaherpes virus 5* | 10371 | *Ramie mosaic Yunnan virus* | 1874886 |
| *Aeropyrum pernix bacilliform virus 1* | 700542 | *Equid gammaherpes virus 7* | 291612 | *Ranid herpesvirus 1* | 85655 |
| *Aeropyrum pernix ovoid virus 1* | 1032474 | *Equine associated gemycircularvirus 1* | 1985379 | *Ranid herpesvirus 2* | 389214 |
| *Aerosvirus AS7* | 2733365 | *Equine encephalosis virus* | 201490 | *Ranid herpesvirus 3* | 1987509 |
| *Aerosvirus av25AhydR2PP* | 2733364 | *Equine foamy virus* | 109270 | *Ranunculus leaf distortion virus* | 341110 |

TABLE 6-continued

Exemplary list of viruses

| Name | NCBI Taxonomy ID | Name | NCBI Taxonomy ID | Name | NCBI Taxonomy ID |
|---|---|---|---|---|---|
| *Aerosvirus ZPAH7* | 2733366 | *Equine infectious anemia virus* | 11665 | *Ranunculus mild mosaic virus* | 341111 |
| *Affertcholeramvirus CTXphi* | 141904 | *Equine mastadenovirus A* | 129954 | *Ranunculus mosaic virus* | 341112 |
| *African cassava mosaic Burkina Faso virus* | 2560285 | *Equine mastadenovirus B* | 129955 | *Raptor siadenovirus A* | 691961 |
| *African cassava mosaic virus* | 10817 | *Equine picobirnavirus* | 2723956 | *Raspberry bushy dwarf virus* | 12451 |
| *African eggplant mosaic virus* | 2056161 | *Equine rhinitis A virus* | 47000 | *Raspberry leaf mottle virus* | 326941 |
| *African horse sickness virus* | 40050 | *Equine torovirus* | 329862 | *Raspberry ringspot virus* | 12809 |
| *African oil palm ringspot virus* | 185218 | *Eracentumvirus era103* | 1985737 | *Rat associated gemycircularvirus 1* | 1985405 |
| *African swine fever virus* | 10497 | *Eracentumvirus S2* | 2733579 | *Rat associated porprismacovirus 1* | 2170126 |
| *Agaricus bisporus alphaendornavirus 1* | 2734345 | *Eragrostis curvula streak virus* | 638358 | *Rattail cactus necrosis-associated virus* | 1123754 |
| *Agaricus bisporus virus 4* | | *Eragrostis minor streak virus* | 1030595 | *Rattus norvegicus polyomavirus 1* | 1679933 |
| *Agatevirus agate* | 1910935 | *Eragrostis streak virus* | 496807 | *Rauchvirus BPP1* | 194699 |
| *Agatevirus bobb* | 1910936 | *Erbovirus A* | 312185 | *Raven circovirus* | 345250 |
| *Agatevirus Bp8pC* | 1910937 | *Erectites yellow mosaic virus* | 390443 | *Ravinvirus N15* | 40631 |
| *Ageratum enation alphasatellite* | 1260769 | *Eriborus terebrans ichnovirus* | | *Recovirus A* | 2560702 |
| *Ageratum enation virus* | 188333 | *Erinnyis ello granulovirus* | 307444 | *Red clover associated luteovirus* | |
| *Ageratum latent virus* | 1386090 | *Eriocheir sinensis reovirus* | 273810 | *Red clover cryptic virus 2* | 1323524 |
| *Ageratum leaf curl Buea betasatellite* | 912035 | *Ermolevavirus PGT2* | 2733903 | *Red clover mottle virus* | 12262 |
| *Ageratum leaf curl Cameroon betasatellite* | 635076 | *Ermolevavirus PhiKT* | 2733904 | *Red clover necrotic mosaic virus* | 12267 |
| *Ageratum leaf curl Sichuan virus* | 2182585 | *Erskinevirus asesino* | 2169882 | *Red clover vein mosaic virus* | 590403 |
| *Ageratum leaf curl virus* | 333293 | *Erskinevirus EaH2* | 2169883 | *Red deerpox virus* | |
| *Ageratum yellow leaf curl betasatellite* | 169687 | *Erysimum latent virus* | 12152 | *Redspotted grouper nervous necrosis virus* | 43763 |
| *Ageratum yellow vein alphasatellite* | 187850 | *Feline associated cyclovirus 1* | 1987742 | *Reginaelenavirus rv3LV2017* | 2734071 |
| *Ageratum yellow vein betasatellite* | 185750 | *Feline calicivirus* | 11978 | *Rehmannia mosaic virus* | 425279 |
| *Ageratum yellow vein China alphasatellite* | 1454227 | *Feline foamy virus* | 53182 | *Rehmannia virus 1* | 2316740 |

TABLE 6-continued

Exemplary list of viruses

| Name | NCBI Taxonomy ID | Name | NCBI Taxonomy ID | Name | NCBI Taxonomy ID |
|---|---|---|---|---|---|
| *Ageratum yellow vein Hualian virus* | 437063 | *Feline immunodeficiency virus* | 11673 | *Reptilian ferlavirus* | 122203 |
| *Ageratum yellow vein India alphasatellite* | 1407058 | *Feline leukemia virus* | 11768 | *Reptilian orthoreovirus* | 226613 |
| *Ageratum yellow vein India betasatellite* | 2010316 | *Feline morbillivirus* | 1170234 | *Rerduovirus* RER2 | 1982376 |
| *Ageratum yellow vein Singapore alphasatellite* | 915293 | *Felipivirus A* | | *Rerduovirus* RGL3 | 1109716 |
| *Ageratum yellow vein Sri Lanka betasatellite* | 2010317 | *Felixounavirus* Alf5 | 2560439 | *Restivirus* RSS1 | 2011075 |
| *Ageratum yellow vein Sri Lanka virus* | 222079 | *Felixounavirus* AYO145A | 1965378 | *Reston ebolavirus* | 186539 |
| *Ageratum yellow vein virus* | 44560 | *Felixounavirus* BPS15Q2 | 2560723 | *Reticuloendotheliosis virus* | 11636 |
| *Aghbyvirus* ISAO8 | 2733367 | *Felsduovirus* 4LV2017 | 2734062 | *Reyvirus rey* | 1983751 |
| *Aglaonema bacilliform virus* | 1512278 | *Felsduovirus* Fels2 | 194701 | *Rhesus macaque simian foamy virus* | 2170199 |
| *Agricanvirus deimos* | 1984777 | *Felsduovirus* RE2010 | 2734063 | *Rhinolophus associated gemykibivirus* 1 | 2004965 |
| *Agricanvirus desertfox* | 2560433 | *Felsduovirus* 4LV2017 | 2734062 | *Rhinolophus associated gemykibivirus* 2 | 2004966 |
| *Agricanvirus* Ea3570 | 1984778 | *Felsduovirus* Fels2 | 194701 | *Rhinolophus bat coronavirus* HKU2 | 693998 |
| *Agricanvirus* ray | 1984779 | *Fernvirus shelly* | 1921560 | *Rhinolophus ferrumequinum alphacoronavirus* HuB-2013 | 2501926 |
| *Agricanvirus* simmy50 | 1984780 | *Fernvirus sitara* | 1921561 | *Rhinovirus A* | 147711 |
| *Agricanvirus* specialG | 1984781 | *Festuca leaf streak cytorhabdovirus* | | *Rhinovirus B* | 147712 |
| *Agropyron mosaic virus* | 41763 | *Fibralongavirus* fv2638A | 2734233 | *Rhinovirus C* | 463676 |
| *Agrotis ipsilon multiple nucleopolyhedrovirus* | 208013 | *Fibralongavirus* QT1 | 2734234 | *Rhizidiomyces virus* | |
| *Agrotis segetum granulovirus* | 10464 | *Fibrovirus* fs1 | 70203 | *Rhizoctonia cerealis alphaendornavirus* 1 | 1408133 |
| *Agrotis segetum nucleopolyhedrovirus A* | 1962501 | *Fibrovirus* VGJ | 1977140 | *Rhizoctonia magoulivirus* 1 | 2560704 |
| *Agrotis segetum nucleopolyhedrovirus B* | 1580580 | *Ficleduovirus* FCL2 | 2560473 | *Sabo orthobunyavirus* | 2560716 |
| *Agtrevirus* AG3 | 1987994 | *Ficleduovirus* FCV1 | 2560474 | *Saboya virus* | 64284 |
| *Agtrevirus* SKML39 | 2169690 | *Fig badnavirus* 1 | 1034096 | *Sacbrood virus* | 89463 |

TABLE 6-continued

Exemplary list of viruses

| Name | NCBI Taxonomy ID | Name | NCBI Taxonomy ID | Name | NCBI Taxonomy ID |
|---|---|---|---|---|---|
| Aguacate phlebovirus | 2734434 | Fig cryptic virus | 882768 | Saccharomyces 20S RNA narnavirus | 186772 |
| Ahlum waterborne virus | | Figulus sublaevis entomopoxvirus | | Saccharum streak virus | 683179 |
| Ahphunavirus Ahp1 | 2733368 | Figwort mosaic virus | 10649 | Saclayvirus Aci011 | 2734138 |
| Ahphunavirus CF7 | 2733369 | Fiji disease virus | 77698 | Saclayvirus Aci022 | 2734139 |
| Ahtivirus sagseatwo | 2734079 | Finch circovirus | 400122 | Saclayvirus Aci05 | 2734137 |
| Aichivirus A | 72149 | Finkel-Biskis-Jinkins murine sarcoma virus | 353765 | Saetivirus fs2 | 1977306 |
| Aichivirus B | 194965 | Finnlakevirus FLip | 2734591 | Saetivirus VFJ | 1977307 |
| Aichivirus C | 1298633 | Fionnbharthvirus fionnbharth | 2955891 | Saffron latent virus | 2070152 |
| Aichivirus D | 1897731 | Fipivirus A | | Saguaro cactus virus | 52274 |
| Aichivirus E | 1986958 | Fipvunavirus Fpv4 | 2560476 | Saguinine gammaherpesvirus 1 | 2169901 |
| Aichivirus F | 1986959 | Firehammervirus CP21 | 1190451 | Saikungvirus HK633 | 2169924 |
| Ailurivirus A | 2560287 | Firehammervirus CP220 | 722417 | Saikungvirus HK75 | 2169925 |
| Aino orthobunyavirus | 2560289 | Firehammervirus CPt10 | 722418 | Saimiri sciureus polyomavirus 1 | 1236410 |
| Air potato ampelovirus 1 | 2560290 | Fischettivirus C1 | 230871 | Saimiriine alphaherpesvirus 1 | 10353 |
| Akabane orthobunyavirus | 1933178 | Fishburnevirus brusacoram | 1983737 | Saimiriir betaherpesvirus 4 | 1535247 |
| Akhmeta virus | 2200830 | Flamingopox virus | 503979 | Saimiriine gammaherpesvirus 2 | 10381 |
| Alajuela orthobunyavirus | 1933181 | Flammulina velutipes browning virus | 568090 | Saint Floris phlebovirus | |
| Alasvirus muscae | 2501934 | Flaumdravirus KIL2 | 2560665 | Saint Louis encephalitis virus | 11080 |
| Alcelaphine gammaherpes virus 1 | 35252 | Flaumdravirus KIL4 | 2560666 | Saint Valerien virus | |
| Alcelaphine gammaherpes virus 2 | 138184 | Fletchervirus CP30A | 1980966 | Sakhalin orthonairovirus | 1980528 |
| Alcube phlebovirus | 2734435 | Gaiavirus gaia | 1982148 | Sakobuvirus A | 1659771 |
| Alcyoneusvirus K641 | 2560541 | Gaillardia latent virus | 1468172 | Sal Vieja virus | 64301 |
| Alcyoneusvirus RaK2 | 2560545 | Gairo mammarenavirus | 1535802 | Salacisavirus pssm2 | 2734140 |
| Alefpapillomavirus 1 | 2169692 | Gajwadongvirus ECBP5 | 2733916 | Salanga phlebovirus | 2734471 |
| Alenquer phlebovirus | 2734436 | Gajwadongvirus PP99 | 2733917 | Salasvirus phi29 | 10756 |
| Alexandravirus AD1 | 2734080 | Galaxyvirus abidatro | 2560298 | Salchichonvirus LP65 | 298338 |
| Alexandravirus alexandra | 2734081 | Galaxyvirus galaxy | 2560303 | Salehabad phlebovirus | 1933188 |
| Alfalfa betanucleorhabdovirus | | Galinsoga mosaic virus | 60714 | Salem salemvirus | 2560718 |
| Alfalfa cryptic virus 1 | | Gallid alphaherpesvirus 1 | 10386 | Salivirus A | 1330524 |
| Alfalfa enamovirus 1 | 1770265 | Gamaleyavirus Sb1 | 1920761 | Salmo aquaparamyxovirus | 2749930 |
| Alfalfa leaf curl virus | 1306546 | Gambievirus bolahunense | 2501933 | Salmon gillpox virus | 2734576 |

TABLE 6-continued

Exemplary list of viruses

| Name | NCBI Taxonomy ID | Name | NCBI Taxonomy ID | Name | NCBI Taxonomy ID |
|---|---|---|---|---|---|
| *Alfalfa mosaic virus* | 12321 | *Gamboa orthobunyavirus* | 1933270 | *Saphexavirus VD13* | 1982380 |
| *Alfalfa virus S* | 1985968 | *Gammaarterivirus lacdeh* | 2499678 | *Sapporo virus* | 95342 |
| *Algerian watermelon mosaic virus* | 515575 | *Gammanucleo rhabdovirus maydis* | 2748968 | *Sarcochilus virus Y* | 104393 |
| *Allamanda leaf curl virus* | 452758 | *Gammapapillo mavirus 1* | 333926 | *Sashavirus sasha* | 2734275 |
| *Allamanda leaf mottle distortion virus* | 1317107 | *Gammapapillo mavirus 10* | 1175852 | *Sasquatchvirus Y3* | 2734143 |
| *Alligatorweed stunting virus* | | *Gammapapillo mavirus 11* | 1513256 | *Sasvirus BFK20* | 2560392 |
| *Allium cepa amalgavirus 1* | 2058778 | *Gayfeather mild mottle virus* | 578305 | *Satsuma dwarf virus* | 47416 |
| *Allium cepa amalgavirus 2* | 2058779 | *Gecko reptillovirus* | 2560481 | *Sauletekiovirus AAS23* | 2734030 |
| *Allium virus X* | 317027 | *Gelderlandvirus melville* | 2560727 | *Saumarez Reef virus* | 40012 |
| *Allpahuayo mammarenavirus* | 144752 | *Gelderlandvirus s16* | 1913658 | *Saundersvirus Tp84* | 2170234 |
| *Almendravirurus almendras* | 1972686 | *Gelderlandvirus stml198* | 1913657 | *Sauropus leaf curl virus* | 1130981 |
| *Almendravirus arboretum* | 1972683 | *Gelderlandvirus stp4a* | 2560734 | *Sawgrhavirus connecticut* | 2734397 |
| *Almendravirus balsa* | 1972684 | *Gentian mosaic virus* | 182452 | *Sawgrhavirus longisland* | 2734398 |
| *Almendravirus chico* | 1972687 | *Gentian ovary ringspot virus* | 1920772 | *Sawgrhavirus minto* | 2734399 |
| *Almendravirus cootbay* | 1972685 | *Geotrupes sylvaticus entomopoxvirus* | | *Sawgrhavirus sawgrass* | 2734400 |
| *Almendravirus menghai* | 2734366 | *Gequatrovirus G4* | 1986034 | *Scale drop disease virus* | 1697349 |
| *Bat associated cyclovirus 6* | 1987731 | *Gequatrovirus ID52* | 1910968 | *Scallion mosaic virus* | 157018 |
| *Bat associated cyclovirus 7* | 1987732 | *Gequatrovirus talmos* | 1910969 | *Scapularis ixovirus* | 2734431 |
| *Bat associated cyclovirus 8* | 1987733 | *Gerygone associated gemycircularvirus 1* | 1985381 | *Scapunavirus scap1* | 2560792 |
| *Bat associated cyclovirus 9* | 1987734 | *Gerygone associated gemycircularvirus 2* | 1985382 | *Scheffersomyces segobiensis virus L* | 1300323 |
| *Bat coronavirus CDPHE15* | 1913643 | *Harrisina brillians granulovirus* | 115813 | *Schefflera ringspot virus* | 2169729 |
| *Bat coronavirus HKU10* | 1244203 | *Harrisonvirus harrison* | 1982221 | *Schiekvirus EFDG1* | 2560422 |
| *Bat Hp-betacoronavirus Zhejiang2013* | 2501961 | *Harvey murine sarcoma virus* | 11807 | *Schiekvirus EFP01* | 2734044 |
| *Bat mastadenovirus A* | 1146877 | *Hautrevirus hau3* | 1982895 | *Schiekvirus EfV12* | 2734045 |
| *Bat mastadenovirus B* | 1146874 | *Havel River virus* | 254711 | *Schistocerca gregaria entomopoxvirus* | |
| *Bat mastadenovirus C* | 2015370 | *Hawkeyevirus hawkeye* | 2169910 | *Saphexavirus VD13* | 1982380 |
| *Bat mastadenovirus D* | 2015372 | *Hazara orthonairovirus* | 1980522 | *Sophora yellow stunt alphasatellite 5* | 2169837 |

TABLE 6-continued

Exemplary list of viruses

| Name | NCBI Taxonomy ID | Name | NCBI Taxonomy ID | Name | NCBI Taxonomy ID |
|---|---|---|---|---|---|
| *Bat mastadenovirus E* | 2015374 | *Heartland bandavirus* | 2747342 | *Sorex araneus coronavirus T14* | 2734504 |
| *Bat mastadenovirus F* | 2015375 | *Hebius tobanivirus 1* | | *Sorex araneus polyomavirus 1* | 2560769 |
| *Bat mastadenovirus G* | 2015376 | *Hedgehog coronavirus 1* | 1965093 | *Sorex coronatus polyomavirus 1* | 2560770 |
| *Bat mastadenovirus H* | | *Hedwigvirus hedwig* | 2560502 | *Sorex minutus polyomavirus 1* | 2560771 |
| *Bat mastadenovirus* | | *Hedyotis uncinella yellow mosaic virus* | 1428190 | *Sorghum chlorotic spot virus* | 107804 |
| *Bat mastadenovirus J* | | *Hedyotis yellow mosaic betasatellite* | 1428189 | *Sorghum mosaic virus* | 32619 |
| *Batai orthobunyavirus* | 2560341 | *Heilongjiangvirus Lb* | 2734110 | *Sororoca orthobunyavirus* | 2560772 |
| *Batama orthobunyavirus* | 1933177 | *Helenium virus S* | 12171 | *Sortsnevirus IME279* | 2734190 |
| *Batfish actinovirus* | 2560342 | *Helianthus annuus alphaendornavirus* | 2184469 | *Sortsnevirus sortsne* | 2734189 |
| *Bavaria virus* | 2560343 | *Helicobasidium mompa alphaendornavirus 1* | 675833 | *Sosuga pararubulavirus* | 2560773 |
| *Baxtervirus baxterfox* | 2169730 | *Helicobasidium mompa partitivirus V70* | 344866 | *Soupsvirus soups* | 1982563 |
| *Baxtervirus yeezy* | 2169731 | *Helicobasidium mompa totivirus 1-17* | 196690 | *Soupsvirus strosahl* | 2560510 |
| *Baylorvirus bv1127AP1* | 2734055 | *Helicoverpa armigera granulovirus* | 489830 | *Soupsvirus wait* | 2560513 |
| *Baylorvirus PHL101* | 376820 | *Helicoverpa armigera nucleopolyhedrovirus* | 51313 | *Souris mammarenavirus* | 2169997 |
| *Bayou orthohantavirus* | 1980459 | *Helicoverpa armigera stunt virus* | 37206 | *Sourvirus sour* | 2560509 |
| *Bcepfunavirus bcepF1* | 417280 | *Heliothis armigera entomopoxvirus* | 10290 | *South African cassava mosaic virus* | 63723 |
| *Bcepmuvirus bcepMu* | 264729 | *Heliothis virescens ascovirus 3a* | 113366 | *Southern bean mosaic virus* | 12139 |
| *Bcepmuvirus E255* | 431894 | *Heliothis zea nudivirus* | 29250 | *Southern cowpea mosaic virus* | 196398 |
| *Bdellomicrovirus MH2K* | 1986027 | *Helleborus mosaic virus* | 592207 | *Southern elephant seal virus* | 1159195 |
| *Bdellovibrio virus MAC1* | | *Helleborus net necrosis virus* | 592206 | *Southern rice black-streaked dwarf virus* | 519497 |
| *Beak and feather disease virus* | 77856 | *Helminthosporium victoriae virus 145S* | 2560520 | *Southern tomato virus* | 591166 |
| *Bean calico mosaic virus* | 31602 | *Helminthosporium victoriae virus 190S* | 45237 | *Sowbane mosaic virus* | 378833 |
| *Bean chlorosis virus* | 1227354 | *Helsettvirus fPS53* | 2733626 | *Soybean associated gemycircularvirus 1* | 1985413 |

TABLE 6-continued

Exemplary list of viruses

| Name | NCBI Taxonomy ID | Name | NCBI Taxonomy ID | Name | NCBI Taxonomy ID |
|---|---|---|---|---|---|
| *Bean common mosaic necrosis virus* | 43240 | *Helsettvirus fPS54ocr* | 2733628 | *Sophora yellow stunt alphasatellite 5* | 2169837 |
| *Bean common mosaic virus* | 12196 | *Helsettvirus fPS59* | 2733627 | *Sorex araneus coronavirus T14* | 2734504 |
| *Bean dwarf mosaic virus* | 10838 | *Helsettvirus fPS9* | 2733625 | *Sorex araneus polyomavirus 1* | 2560769 |
| *Bean golden mosaic virus* | 10839 | *Helsingorvirus Cba121* | 1918193 | *Sorex coronatus polyomavirus 1* | 2560770 |
| *Bean golden yellow mosaic virus* | 220340 | *Helsingorvirus Cba171* | 1918194 | *Sorex minutus polyomavirus 1* | 2560771 |
| *Bean leaf crumple virus* | 2004460 | *Jujube mosaic-associated virus* | 2020956 | *Sorghum chlorotic spot virus* | 107804 |
| *Bean leafroll virus* | 12041 | *Jun jeilongvirus* | 2560536 | *Sorghum mosaic virus* | 32619 |
| *Bean mild mosaic virus* | | *Juncopox virus* | | *Sororoca orthobunyavirus* | 2560772 |
| *Bean necrotic mosaic orthotospovirus* | 2560344 | *Jutiapa virus* | 64299 | *Sortsnevirus IME279* | 2734190 |
| *Bean pod mottle virus* | 12260 | *Jwalphavirus jwalpha* | 2169963 | *Switchgrass mosaic-associated virus* | 2049938 |
| *Bean rugose mosaic virus* | 128790 | *Kabuto mountain uukuvirus* | 2747382 | *Symapivirus A* | |
| *Bean white chlorosis mosaic virus* | 2169732 | *Kadam virus* | 64310 | *Synechococcus virus SRIM12-08* | 2734100 |
| *Bean yellow disorder virus* | 267970 | *Kadipiro virus* | 104580 | *Synedrella leaf curl alphasatellite* | 1544378 |
| *Bean yellow mosaic Mexico virus* | 714310 | *Kaeng Khoi orthobunyavirus* | 1933275 | *Synedrella yellow vein clearing virus* | 1914900 |
| *Bean yellow mosaic virus* | 12197 | *Kafavirus SWcelC56* | 2733923 | *Synetaeris tenuifemur ichnovirus* | |
| *Bear Canyon mammarenavirus* | 192848 | *Kafunavirus KF1* | 1982588 | *Syngnathid ichthamaparvovirus 1* | 2734305 |
| *Beauveria bassiana polymycovirus 1* | 1740646 | *Kagunavirus golestan* | 2560464 | *Synodus synodonvirus* | 2749934 |
| *Beauveria bassiana victorivirus 1* | 1685109 | *Kagunavirus K1G* | 1911008 | *Tabernariusvirus tabernarius* | 2560691 |
| *Bebaru virus* | 59305 | *Kagunavirus K1H* | 1911010 | *Tacaiuma orthobunyavirus* | 611707 |
| *Beecentumtre virus B103* | 10778 | *Kagunavirus Klind1* | 1911007 | *Tacaribe mammarenavirus* | 11631 |
| *Beet black scorch virus* | 196375 | *Kagunavirus Klind2* | 1911009 | *Tacheng uukuvirus* | 2734606 |
| *Beet chlorosis virus* | 131082 | *Kagunavirus RP180* | 2734197 | *Tahyna orthobunyavirus* | 2560796 |
| *Beet cryptic virus 1* | 509923 | *Merremia mosaic virus* | 77813 | *Tangaroavirus tv951510a* | 2733962 |
| *Beet cryptic virus 2* | 912029 | *Mesta yellow vein mosaic alphasatellite* | 1705093 | *Tankvirus tank* | 1982567 |
| *Beet cryptic virus 3* | 29257 | *Mesta yellow vein mosaic Bahraich virus* | 508748 | *Tapara phlebovirus* | 2734474 |
| *Beet curly top Iran virus* | 391228 | *Metamorphoo virus fireman* | 2734253 | *Tapirape pacuvirus* | 2560798 |
| *Beet curly top virus* | 10840 | *Metamorphoo virus metamorphoo* | 2734254 | *Tapwovirus cesti* | 2509383 |
| *Beet mild yellowing virus* | 156690 | *Metamorphoo virus robsfeet* | 2734255 | *Taranisvirus taranis* | 2734146 |

TABLE 6-continued

Exemplary list of viruses

| Name | NCBI Taxonomy ID | Name | NCBI Taxonomy ID | Name | NCBI Taxonomy ID |
|---|---|---|---|---|---|
| *Beet mosaic virus* | 114921 | *Metrivirus ME3* | 2560269 | *Taro bacilliform CH virus* | 1634914 |
| *Beet necrotic yellow vein virus* | 31721 | *Mguuvirus JG068* | 2733593 | *Taro bacilliform virus* | 178354 |
| *Beet pseudoyellows virus* | 72750 | *Microbacterium virus MuffinTheCat [2]* | | *Tarumizu coltivirus* | 2734340 |
| *Beet ringspot virus* | 191547 | *Microcystis virus Ma-LMM01* | 340435 | *Tataguine orthobunyavirus* | 2560799 |
| *Beet soil-borne mosaic virus* | 76343 | *Microhyla letovirus 1* | | *Taterapox virus* | 28871 |
| *Beet soil-borne virus* | 46436 | *Micromonas pusilla reovirus* | 338781 | *Taupapillomavirus 1* | 1176148 |
| *Beet virus Q* | 71972 | *Micromonas pusilla virus SP1* | 373996 | *Taupapillomavirus 2* | 1513274 |
| *Beet western yellows virus* | 12042 | *Microplitis croceipes bracovirus* | | *Taupapillomavirus 3* | 1961786 |
| *Beet yellow stunt virus* | 35290 | *Microtus arvalis polyomavirus 1* | 2006148 | *Taupapillomavirus 4* | 2170222 |
| *Beet yellows virus* | 12161 | *Mukerjeevirus mv52B1* | 2734186 | *Taura syndrome virus* | 142102 |
| *Beetle mivirus* | | *Mulberry badnavirus 1* | 1227557 | *Tawavirus JSF7* | 2733965 |
| *Beetrevirus B3* | 2560656 | *Mulberry mosaic dwarf associated virus* | 1631303 | *Tea plant necrotic ring blotch virus* | 2419939 |
| *Beetrevirus JBD67* | 2560663 | *Mulberry mosaic leaf roll associated virus* | 1527441 | *Tefnutvirus siom 18* | 2734147 |
| *Beetrevirus JD18* | 2560664 | *Mulberry ringspot virus* | | *Tegunavirus r1rt* | 1921705 |
| *Beetrevirus PM105* | 2560675 | *Mulberry vein banding associated orthotospovirus* | | *Tegunavirus yenmtg1* | 1921706 |
| *Beihai picobirnavirus* | | *Mule deerpox virus* | 304399 | *Tehran phlebovirus* | 2734475 |
| *Beilong jeilongvirus* | 2560345 | *Mume virus A* | 2137858 | *Telfairia golden mosaic virus* | 2169737 |
| *Bell pepper alphaendornavirus* | 354328 | *Mumps orthorubulavirus* | 2560602 | *Telfairia mosaic virus* | 1859135 |
| *Bell pepper mottle virus* | 368735 | *Mungbean yellow mosaic betasatellite* | 2010322 | *Tellina virus* | 359995 |
| *Belladonna mottle virus* | 12149 | *Mukerjeevirus mv52B1* | 2734186 | *Tellina virus 1* | 321302 |
| *Bellamyvirus bellamy* | 2734095 | *Mulberry badnavirus 1* | 1227557 | *Telosma mosaic virus* | 400394 |
| *Bellavista orthobunyavirus* | 2560346 | *Mulberry mosaic dwarf associated virus* | 1631303 | *Tembusu virus* | 64293 |
| *Bellflower vein chlorosis virus* | 1720595 | *Mycobacterium virus Tweety* | 1993864 | *Tensaw orthobunyavirus* | 2560800 |
| *Bellflower veinal mottle virus* | 1982660 | *Mycobacterium virus Wee* | 1993860 | *Tent-making bat hepatitis B virus* | 1508712 |
| *Beluga whale coronavirus SW1* | 694015 | *Mycobacterium virus Wildcat* | 1993859 | *Teseptimavirus YpsPG* | 2733885 |

TABLE 6-continued

Exemplary list of viruses

| Name | NCBI Taxonomy ID | Name | NCBI Taxonomy ID | Name | NCBI Taxonomy ID |
|---|---|---|---|---|---|
| *Bendigovirus GMA6* | 2560495 | *Mycoreovirus 1* | 311228 | *Testudine orthoreovirus* | |
| *Benedictvirus cuco* | 1071502 | *Mycoreovirus 2* | 404237 | *Testudinid alphaherpesvirus 3* | 2560801 |
| *Benedictvirus tiger* | 1993876 | *Mycoreovirus 3* | 311229 | *Tete orthobunyavirus* | 35319 |
| *Benevides orthobunyavirus* | 2170054 | *Mylasvirus persius* | 1914020 | *Tetterwort vein chlorosis virus* | 1712389 |
| *Bequatrovirus avesobmore* | 1984785 | *Mynahpox virus* | 2169711 | *Teviot pararubulavirus* | 2560803 |
| *Bequatrovirus B4* | 1918005 | *Myodes coronavirus 2JL14* | | *Thailand orthohantavirus* | 1980492 |
| *Bequatrovirus bigbertha* | 1918006 | *Myodes glareolus polyomavirus 1* | 2006147 | *Thalassavirus thalassa* | 2060093 |
| *Bequatrovirus riley* | 1918007 | *Myodes jeilongvirus* | 2560609 | *Thaumasvirus stim4* | 2734148 |
| *Bequatrovirus spock* | 1918008 | *Myodes narmovirus* | 2560610 | *Thermoproteus tenax spherical virus 1* | 292639 |
| *Bequatrovirus troll* | 1918009 | *Myohalovirus phiH* | 1980944 | *Thermoproteus tenax virus 1* | 10479 |
| *Berhavirus beihaiense* | 2509379 | *Noxifervirus noxifer* | 2560671 | *Thermus virus IN93* | 1714273 |
| *Berhavirus radialis* | 2509380 | *Ntaya virus* | 64292 | *Thermus virus P23-77* | 1714272 |
| *Berhavirus sipunculi* | 2509381 | *Ntepes phlebovirus* | 2734464 | *Thetaarterivirus kafuba* | 2501999 |
| *Berisnavirus 1* | 2734518 | *Nuarterivirus guemel* | | *Thetaarterivirus mikelba 1* | 2502000 |
| *Cacao yellow mosaic virus* | 12150 | *Nudaurelia capensis beta virus* | 85652 | *Thetapapillomavirus 1* | 197772 |
| *Cacao yellow vein banding virus* | 2169726 | *Nudaurelia capensis omega virus* | 12541 | *Thetapolyomavirus censtriata* | 1891755 |
| *Cache Valley orthobunyavirus* | 2560364 | *Nupapillomavirus 1* | 334205 | *Thetapolyomavirus trebernacchii* | 2218588 |
| *Cachoeira Porteira orthobunyavirus* | 2560365 | *Nyando orthobunyavirus* | 1933306 | *Thetapolyomavirus trepennellii* | 2170103 |
| *Cacipacore virus* | 64305 | *Nyavirus midwayense* | 644609 | *Thetisvirus ssm1* | 2734149 |
| *Cactus mild mottle virus* | 229030 | *Nyavirus nyamaniniense* | 644610 | *Thiafora orthonairovirus* | 1980529 |
| *Cactus virus 2* | | *Nyavirus sierranevadaense* | 1985708 | *Thimiri orthobunyavirus* | 1819305 |
| *Cactus virus X* | 112227 | *Nyceiraevirus nyceirae* | 2560506 | *Thin paspalum asymptomatic virus* | 1352511 |
| *Cadicivirus A* | 1330068 | *Nyctalus velutinus alphacoronavirus SC-2013* | 2501928 | *Thistle mottle virus* | |
| *Cadicivirus B* | 2560366 | *Nylanderia fulva virus 1* | 1871153 | *Thogotovirus dhoriense* | 11318 |
| *Caenorhabditis elegans Cer1 virus* | | *Nymphadoravirus kita* | 2170041 | *Thogotovirus thogotoense* | 11569 |
| *Caenorhabditis elegans Cer 13 virus* | | *Nymphadoravirus nymphadora* | 2560507 | *Thomixvirus OH3* | 2560804 |
| *Caeruleovirus Bc431* | 1985175 | *Nymphadoravirus zirinka* | 2170042 | *Thornevirus SP15* | 2560336 |
| *Caeruleovirus Bcp1* | 1985176 | *Oat blue dwarf virus* | 56879 | *Thosea asigna virus* | 83810 |
| *Caeruleovirus BCP82* | 1985177 | *Oat chlorotic stunt virus* | 146762 | *Thottopalayam thottimvirus* | 2501370 |
| *Caeruleovirus BM15* | 1985178 | *Oat dwarf virus* | 497863 | *Thunberg fritillary mosaic virus* | 299200 |

TABLE 6-continued

Exemplary list of viruses

| Name | NCBI Taxonomy ID | Name | NCBI Taxonomy ID | Name | NCBI Taxonomy ID |
|---|---|---|---|---|---|
| *Caeruleovirus deepblue* | 1985179 | *Oat golden stripe virus* | 45103 | *Thysanoplusia orichalcea nucleopolyhedro virus* | 101850 |
| *Caeruleovirus JBP901* | 1985180 | *Oxbow orthohantavirus* | 1980484 | *Tiamatvirus PSSP7* | 268748 |
| *Cafeteria roenbergensis virus* | 1513235 | *Oxyplax ochracea nucleopoly-hedrovirus* | 2083176 | *Tibetan frog hepatitis B virus* | 2169919 |
| *Cafeteriavirus -dependent mavirus* | 1932923 | *Paadamvirus RHEph01* | | *Tibrovirus alphaekpoma* | 1987018 |
| *Caimito pacuvirus* | 2734421 | *Pacific coast uukuvirus* | | *Tibrovirus beatrice* | 2170224 |
| *Cajanus cajan Panzee virus* | | *Pacui pacuvirus* | 2560617 | *Tibrovirus betaekpoma* | 1987019 |
| *Caladenia virus A* | 1198147 | *Paenibacillus virus Willow* | | *Tibrovirus coastal* | 1972586 |
| *Calanthe mild mosaic virus* | 73840 | *Pagavirus S05C849* | | *Tibrovirus congo* | 1987017 |
| *Cali mammarenavirus* | 2169993 | *Pagevirus page* | | *Tibrovirus sweetwater* | 1987013 |
| *Calibrachoa mottle virus* | 204928 | *Pagevirus palmer* | | *Tibrovirus tibrogargan* | 1972584 |
| *California encephalitis orthobunyavirus* | 1933264 | *Pagevirus pascal* | | Tick associated circovirus 1 | 2560805 |
| *California reptarenavirus* | 2170175 | *Pagevirus pony* | | Tick associated circovirus 2 | 2560806 |
| *Caligid hexartovirus* | | *Pagevirus pookie* | | Tick-borne encephalitis virus | 11084 |
| *Caligrhavirus caligus* | 2560367 | *Pagoda yellow mosaic associated virus* | 1505530 | *Tico phebovirus* | 2734476 |
| *Caligrhavirus lepeophtheirus* | 2560551 | *Paguronivirus 1* | 2508237 | *Tidunavirus pTD1* | 2560834 |
| *Caligrhavirus salmonlouse* | 2560736 | *Pahexavirus ATCC29399BC* | 1982252 | *Tidunavirus VP4B* | 2560833 |
| *Calla lily chlorotic spot orthotospovirus* | 2560368 | *Pahexavirus pirate* | 1982303 | *Tiger puffer nervous necrosis virus* | 43764 |
| *Calla lily latent virus* | 243560 | *Pahexavirus procrass 1* | 1982304 | *Tigray orthohantavirus* | 2560807 |
| *Callistephus mottle virus* | 1886606 | *Pahexavirus SKKY* | 1982305 | *Tigrvirus E122* | 431892 |
| *Callitrichine gammaherpes virus 3* | 106331 | *Pahexavirus solid* | 1982306 | *Tigrvirus E202* | 431893 |
| *Calopogonium yellow vein virus* | | *Pahexavirus stormborn* | 1982307 | Tobacco leaf curl Comoros virus | 439423 |
| *Camel associated drosmacovirus 1* | 2169876 | *Pahexavirus wiZZO* | 1982308 | Tobacco leaf curl Cuba virus | 336987 |
| *Camel associated drosmacovirus 2* | 2169877 | *Pahsextavirus pAh6C* | 2733975 | Tobacco leaf curl Dominican Republic virus | 2528965 |
| *Camel associated porprismacovirus 1* | 2170105 | *Pairvirus Lo5R7ANS* | 2733941 | Tobacco leaf curl Japan betasatellite | 2010326 |
| *Camel associated porprismacovirus 2* | 2170106 | *Pakpunavirus CAb02* | 1921409 | Tobacco leaf curl Patna betasatellite | 2010327 |
| *Camel associated porprismacovirus 3* | 2170107 | *Pahexavirus pirate* | 1982303 | Tobacco leaf curl Pusa virus | 905054 |

TABLE 6-continued

Exemplary list of viruses

| Name | NCBI Taxonomy ID | Name | NCBI Taxonomy ID | Name | NCBI Taxonomy ID |
|---|---|---|---|---|---|
| Camel associated porprismacovirus 4 | 2170108 | Pahexavirus procrass 1 | 1982304 | Tobacco leaf curl Thailand virus | 409287 |
| Camelpox virus | 28873 | Pahexavirus SKKY | 1982305 | Tobacco leaf curl Yunnan virus | 211866 |
| Campana phlebovirus | 2734442 | Pea necrotic yellow dwarf virus | 753670 | Tobacco leaf curl Zimbabwe virus | 223337 |
| Campoletis aprilis ichnovirus | | Pea seed-borne mosaic virus | 12208 | Tobacco leaf rugose virus | 196691 |
| Campoletis flavicincta ichnovirus | | Pea stem necrosis virus | 199361 | Veracruzvirus heldan | 1032892 |
| Camptochironomus tentans entomopoxvirus | | Pea streak virus | 157777 | Veracruzvirus rockstar | 2003502 |
| Campylobacter virus IBB35 | 1006972 | Pea yellow stunt virus | 1436892 | Verbena latent virus | 134374 |
| Camvirus amela | 1982882 | Peach chlorotic mottle virus | 471498 | Verbena virus Y | 515446 |
| Camvirus CAM | 1982883 | Peach latent mosaic viroid | 12894 | Vernonia crinkle virus | 1925153 |
| Canary circovirus | 142661 | Peach marafivirus D | 2169999 | Vernonia yellow vein betasatellite | 666635 |
| Canarypox virus | 44088 | Peach mosaic virus | 183585 | Vernonia yellow vein Fujian alphasatellite | 2169908 |
| Candida albicans Tca2 virus | | Peach rosette mosaic virus | 65068 | Vernonia yellow vein Fujian betasatellite | 2050589 |
| Candida albicans Tca5 virus | | Peanut chlorotic streak virus | 35593 | Vernonia yellow vein Fujian virus | 1001341 |
| Candiru phlebovirus | 1933182 | Peanut clump virus | 28355 | Vernonia yellow vein virus | 367061 |
| Canid alphaherpesvirus 1 | 170325 | Peanut yellow mosaic virus | | Versovirus VfO3K6 | 2011076 |
| Canine associated gemygorvirus 1 | 1985425 | Pear blister canker viroid | 12783 | Verticillium dahliae chrysovirus 1 | 759389 |
| Canine circovirus | 1194757 | Peaton orthobunyavirus | 2560627 | Vesicular exanthema of swine virus | 35612 |
| Canine mastadenovirus A | 10537 | Peatvirus peat2 | 2560629 | Vesiculovirus alagoas | 1972579 |
| Canine morbillivirus | 11232 | Pecan mosaic-associated virus | 1856031 | Vesiculovirus bogdanovac | 1972567 |
| Canna yellow mottle associated virus | 2560371 | Pecentumvirus A511 | 40523 | Whitefly-associated begomovirus 7 | 2169744 |
| Canna yellow mottle virus | 419782 | Penicillum brevicompactum polymycovirus 1 | 2734569 | White-tufted-ear marmoset simian foamy virus | 2170205 |
| Canna yellow streak virus | 433462 | Pennisetum mosaic virus | 221262 | Whitewater Arroyo mammarenavirus | 46919 |
| Cannabis cryptic virus | 1115692 | Pepino mosaic virus [3] | | Wifcevirus ECML117 | 2734154 |
| Cano Delgadito orthohantavirus | 1980463 | Pepo aphid-borne yellows virus | 1462681 | Wifcevirus FEC19 | 2734155 |
| Canoevirus canoe | 2734056 | Pepper chat fruit viroid | 574040 | Wifcevirus WFC | 2734156 |

TABLE 6-continued

Exemplary list of viruses

| Name | NCBI Taxonomy ID | Name | NCBI Taxonomy ID | Name | NCBI Taxonomy ID |
|---|---|---|---|---|---|
| *Cao Bang orthohantavirus* | 1980464 | *Pepper chlorotic spot orthotospovirus* | 2734493 | *Wifcevirus WFH* | 2734157 |
| *Caper latent virus* | 1031708 | *Phietavirus X2* | 320850 | *Wigeon coronavirus HKU20* | 1159908 |
| *Capim orthobunyavirus* | 1933265 | *Phifelvirus FL1* | 1633149 | *Wild cucumber mosaic virus* | 70824 |
| *Capistrivirus KSF1* | 2011077 | *Phikmvvirus 15pyo* | 2733349 | *Wild melon banding virus* | |
| *Capraria yellow spot virus* | 2049955 | *Phlox virus S* | 436066 | *Wild onion symptomless virus* | 1862127 |
| *Caprine alphaherpesvirus 1* | 39944 | *Phnom Penh bat virus* | 64894 | *Wild potato mosaic virus* | 187977 |
| *Caprine arthritis encephalitis virus* | 11660 | *Phocid alphaherpesvirus 1* | 47418 | *Wild tomato mosaic virus* | 400396 |
| *Caprine gammaherpes virus 2* | 135102 | *Phocid gammaherpes virus 2* | 47419 | *Wild Vitis latent virus* | 2560839 |
| *Caprine respirovirus 3* | 2560372 | *Phocid gammaherpes virus 3* | 2560643 | *Wilnyevirus billnye* | 2560486 |
| *Capsicum chlorosis orthotospovirus* | 2560373 | *Phocine morbillivirus* | 11240 | *Wilsonroadvirus Sd1* | 2734007 |
| *Capsicum India alphasatellite* | 2734586 | *Pholetesor ornigis bracovirus* | | *Winged bean alphaendornavirus 1* | 2169693 |
| *Captovirus AFV1* | 235266 | *Phthorimaea operculella granulovirus* | 192584 | *Winklervirus chi14* | 2560752 |
| *Capuchin monkey hepatitis B virus* | 2163996 | *Phutvirus PPpW4* | 2733655 | *Wiseana signata nucleopolyhedro virus* | 65124 |
| *Caraparu orthobunyavirus* | 1933290 | *Phyllosphere sclerotimonasvirus* | | *Wissadula golden mosaic virus* | 51673 |
| *Carbovirus queenslandense* | 2136037 | *Physalis mottle virus* | 72539 | *Wissadula yellow mosaic virus* | 1904884 |
| *Dyonupapillo mavirus 1* | 1513250 | *Physarum polycephalum Tp1 virus* | | *Wisteria badnavirus 1* | 1973265 |
| *Dyoomegapap illomavirus 1* | 1918731 | *Phytophthora alphaendornavirus 1* | 310750 | *Wisteria vein mosaic virus* | 201862 |
| *Dyoomikronp apillomavirus 1* | 1513251 | *Picardvirus picard* | 2734264 | *Witwatersrand orthobunyavirus* | 2560841 |
| *Dyophipapillo mavirus 1* | 1920493 | *Pidgey pidchovirus* | 2509390 | *Wizardvirus twister6* | 2170253 |
| *Dyopipapillo mavirus 1* | 1513252 | *Piedvirus IMEDE1* | 2733947 | *Wizardvirus wizard* | 2170254 |
| *Dyopsipapillo mavirus 1* | 1920498 | *Pienvirus R801* | 2733373 | *Woesvirus woes* | 1982751 |
| *Dyorhopapillo mavirus 1* | 1513253 | *Pifdecavirus IBBPF7A* | 2733657 | *Wolkberg orthobunyavirus* | 2170059 |
| *Dyosigmapapi llomavirus 1* | 1513254 | *Plum bark necrosis stem pitting-associated virus* | 675077 | *Wongorr virus* | 47465 |
| *Dyotaupapillo mavirus 1* | 1932910 | *Plum pox virus* | 12211 | *Wongtaivirus HK542* | 2169922 |
| *Dyothetapapill omavirus 1* | 1235662 | *Plumeria mosaic virus* | 1501716 | *Woodchuck hepatitis virus* | 35269 |
| *Dyoupsilonpa pillomavirus 1* | 1932912 | *Plutella xylostella granulovirus* | 98383 | *Woodruffvirus TP1604* | 1982746 |

TABLE 6-continued

Exemplary list of viruses

| Name | NCBI Taxonomy ID | Name | NCBI Taxonomy ID | Name | NCBI Taxonomy ID |
|---|---|---|---|---|---|
| *Dyoxipapillomavirus* 1 | 1513255 | *Poa semilatent virus* | 12328 | *Woodruffvirus YDN12* | 1982747 |
| *Dyoxipapillomavirus* 2 | 2169881 | *Poaceae associated gemycircularvirus 1* | 1985392 | *Woolly monkey hepatitis B virus* | 68416 |
| *Dyozetapapillomavirus* 1 | 1177766 | *Podivirus S05C243* | 2733948 | *Woolly monkey sarcoma virus* | 11970 |
| *Eapunavirus Eap1* | 2733615 | *Poecivirus A* | 2560644 | *Wound tumor virus* | 10987 |
| *East African cassava mosaic Cameroon virus* | 223262 | *Pogseptimavirus PG07* | 2733996 | *Wphvirus BPS10C* | 2560329 |
| *East African cassava mosaic Kenya virus* | 393599 | *Pogseptimavirus VspSw1* | 2733997 | *Wphvirus BPS13* | 1987727 |
| *East African cassava mosaic Malawi virus* | 223264 | *Poindextervirus BL10* | 2734196 | *Wphvirus hakuna* | 1987729 |
| *East African cassava mosaic virus* | 62079 | *Poindextervirus rogue* | 2748760 | *Wphvirus megatron* | 1987728 |
| *East African cassava mosaic Zanzibar virus* | 223275 | *Poinsettia latent virus* | 305785 | *Wphvirus WPh* | 1922328 |
| *East Asian Passiflora distortion virus* | 2734556 | *Poinsettia mosaic virus* | 113553 | *Wuchang cockroach orthophasmavirus 1* | 1980542 |
| *East Asian Passiflora virus* | 341167 | *Pokeweed mosaic virus* | 1220025 | *Wuhan mivirus* | 2507319 |
| *Eastern chimpanzee simian foamy virus* | 2170195 | *Pokrovskaiavirus fHe Yen301* | 2733374 | *Wuhan mosquito orthophasmavirus 1* | 1980543 |
| *Eastern equine encephalitis virus* | 11021 | *Pokrovskaiavirus pv8018* | 2733375 | *Wuhan mosquito orthophasmavirus 2* | 1980544 |
| *Eastern kangaroopox virus* | 2734571 | *Polar bear mastadenovirus A* | | *Wuhanvirus PHB01* | 2733969 |
| *Eastlansingvirus Sf12* | 2734004 | *Pollockvirus pollock* | 2170215 | *Wuhanvirus PHB02* | 2733970 |
| *Echarate phlebovirus* | 2734447 | *Pollyceevirus pollyC* | 2560679 | *Wumivirus millepedae* | 2509286 |
| *Echinochloa hoja blanca tenuivirus* | 42630 | *Polybotosvirus Atuph07* | 2560286 | *Wumpquatrovirus WMP4* | 400567 |
| *Echinochloa ragged stunt virus* | | *Polygonum ringspot orthotospovirus* | 430606 | *Wumptrevirus WMP3* | 440250 |
| *Eclipta yellow vein alphasatellite* | 2030126 | *Pomona bat hepatitis B virus* | 2049933 | *Wutai mosquito phasivirus* | 1980612 |
| *Eclipta yellow vein virus* | 875324 | *Pongine gammaherpesvirus 2* | 159603 | *Wyeomyia orthobunyavirus* | 273350 |
| *Eclunavirus EcL1* | 2560414 | *Poplar mosaic virus* | 12166 | *Xanthophyllomyces dendrorhous virus L1A* | 1167690 |
| *Ectocarpus fasciculatus virus a* | 2083183 | *Popoffvirus pv56* | 2560283 | *Xanthophyllomyces dendrorhous virus L1B* | 1167691 |
| *Ectocarpus siliculosus virus 1* | 37665 | *Porcine associated gemycircularvirus 1* | 1985393 | *Xapuri mammarenavirus* | 2734417 |

TABLE 6-continued

Exemplary list of viruses

| Name | NCBI Taxonomy ID | Name | NCBI Taxonomy ID | Name | NCBI Taxonomy ID |
| --- | --- | --- | --- | --- | --- |
| *Ectocarpus siliculosus virus a* | | *Potato virus Y* | 12216 | *Xestia c-nigrum granulovirus* | 51677 |
| *Ectromelia virus* | 12643 | *Potato yellow blotch virus* | 2230887 | *Xiamenvirus RDJL1* | 1982373 |
| *Ectropis obliqua nucleopolyhed rovirus* | 59376 | *Potato yellow mosaic Panama virus* | 223307 | *Xiamenvirus RDJL2* | 1982374 |
| *Ectropis obliqua virus* | 1225732 | *Potato yellow mosaic virus* | 10827 | *Xilang striavirus* | 2560844 |
| *Edenvirus eden* | 2734230 | *Potato yellow vein virus* | 103881 | *Xinzhou mivirus* | 2507320 |
| *Edge Hill virus* | 64296 | *Pothos latent virus* | 44562 | *Xipapillomavirus 1* | 10561 |
| *Efquatrovirus AL2* | 2560415 | *Potosi orthobunyavirus* | 2560646 | *Xipapillomavirus 2* | 1513273 |
| *Efquatrovirus AL3* | 2560416 | *Poushouvirus Poushou* | 2560396 | *Yokohamavirus PEi21* | 1980942 |
| *Efquatrovirus AUEF3* | 2560417 | *Pouzolzia golden mosaic virus* | 1225069 | *Yokose virus* | 64294 |
| *Efquatrovirus EcZZ2* | 2560424 | *Primate T-lymphotropic virus 3* | 194443 | *Yoloswagvirus yoloswag* | 2734158 |
| *Efquatrovirus EF3* | 2560420 | *Primolicivirus Pf1* | 2011081 | *Yongjia uukuvirus* | 2734607 |
| *Efquatrovirus EF4* | 2560421 | *Primula malacoides virus 1* | 1511840 | *Youcai mosaic virus* | 228578 |
| *Efquatrovirus EfaCPT1* | 2560425 | *Priunavirus PR1* | 2560652 | *Yunnan orbivirus* | 306276 |
| *Efquatrovirus IME196* | 2560426 | *Privet ringspot virus* | 2169960 | *Yushanvirus Spp001* | 2733978 |
| *Efquatrovirus LY0322* | 2560427 | *Prochlorococcus virus PHM1* | | *Yushanvirus SppYZU05* | 2733979 |
| *Efquatrovirus PMBT2* | 2560428 | *Prospect Hill orthohantavirus* | 1980485 | *Yuyuevirus beihaiense* | 2508254 |
| *Efquatrovirus SANTOR1* | 2560429 | *Protapanteles paleacritae bracovirus* | | *Yuyuevirus shaheense* | 2508255 |
| *Efquatrovirus SHEF2* | 2560430 | *Providence virus* | 213633 | *Zaire ebolavirus* | 186538 |
| *Efquatrovirus SHEF4* | 2560431 | *Prune dwarf virus* | 33760 | *Zaliv Terpeniya uukuvirus* | 2734608 |
| *Efquatrovirus SHEF5* | 2560432 | *Prunus latent virus* | 2560653 | *Zantedeschia mild mosaic virus* | 270478 |
| *Eganvirus EtG* | 2734059 | *Prunus necrotic ringspot virus* | 37733 | *Zarhavirus zahedan* | 2734410 |
| *Eganvirus ev186* | 29252 | *Przondovirus KN31* | 2733672 | *Zika virus* | 64320 |

The cascade assays described herein are particularly well-suited for simultaneous testing of multiple targets. Pools of two to 10,000 target nucleic acids of interest may be employed, e.g., pools of 2-1,000, 2-100, 2-50, or 2-10 target nucleic acids of interest. Further testing may be used to identify the specific member of the pool, if warranted.

While the methods described herein do not require the target nucleic acid of interest to be DNA (and in fact it is specifically contemplated that the target nucleic acid of interest may be RNA), it is understood by those in the field that a reverse transcription step to convert target RNA to cDNA may be performed prior to or while contacting the biological sample with the composition.

Nucleic Acid-Guided Nucleases

The cascade assays comprise nucleic acid-guided nucleases in the reaction mix, either provided as a protein, a coding sequence for the protein, or, in many embodiments, in a ribonucleoprotein (RNP) complex. In some embodiments, the one or more nucleic acid-guided nucleases in the reaction mix may be, for example, a Cas nucleic acid-guided nuclease. Any nucleic acid-guided nuclease having both cis- and trans-cleavage activity may be employed, and the same nucleic acid-guided nuclease may be used for both RNP complexes or different nucleic acid-guided nucleases may be used in RNP1 and RNP2. For example, RNP1 and RNP2 may both comprise Cas12a nucleic acid-guided nucleases, or RNP1 may comprise a Cas13 nucleic acid-guided nuclease and RNP2 may comprise a Cas12a nucleic acid-guided nuclease or vice versa. In embodiments where a variant nucleic acid-guided nuclease is employed, only RNP2 will comprise the variant, and RNP1 may comprise either a Cas12a or Cas13 nucleic acid-guided nuclease. In embodiments where a variant nucleic acid-guided nuclease is not employed, either or both RNP1 and RNP2 can comprise a Cas13 nucleic acid-guided nuclease. Note that trans-cleavage activity is not triggered unless and until cis-cleavage activity (i.e., sequence specific activity) is initiated. Nucleic acid-guided nucleases include Type V and Type VI nucleic acid-guided nucleases, as well as nucleic acid-guided nucleases that comprise a RuvC nuclease domain or a RuvC-like nuclease domain but lack an HNH nuclease domain. Nucleic acid-guided nucleases with these properties are reviewed in Makarova and Koonin, Methods Mol. Biol., 1311:47-75 (2015) and Koonin, et al., Current Opinion in Microbiology, 37:67-78 (2020) and updated databases of nucleic acid-guided nucleases and nuclease systems that include newly-discovered systems include BioGRID ORCS (orcs: thebiogrid.org); GenomeCRISPR (genomecrispr.org); Plant Genome Editing Database (plantcrispr.org) and CRISPR-CasFinder (crispercas.i2bc.paris-saclay.fr).

The type of nucleic acid-guided nuclease utilized in the method of detection depends on the type of target nucleic acid of interest to be detected. For example, a DNA nucleic acid-guided nuclease (e.g., a Cas12a, Cas14a, or Cas3) should be utilized if the target nucleic acid of interest is a DNA molecule, and an RNA nucleic acid-guided nuclease (e.g., Cas13a or Cas12g) should be utilized if the target nucleic acid of interest is an RNA molecule. Exemplary nucleic acid-guided nucleases include, but are not limited to, Cas RNA-guided DNA nucleic acid-guided nucleases, such as Cas3, Cas12a (e.g., AsCas12a, LbCas12a), Cas12b, Cas12c, Cas12d, Cas12e, Cas14, Cas12h, Cas12i, and Cas12j; Cas RNA-guided RNA nucleic acid-guided nucleases, such as Cas13a (LbaCas13, LbuCas13, LwaCas13), Cas13b (e.g., CccaCas13b, PsmCas13b), and Cas12g; and any other nucleic acid (DNA, RNA, or cDNA) targeting nucleic acid-guided nuclease with cis-cleavage activity and collateral trans-cleavage activity. In some embodiments, the nucleic acid-guided nuclease is a Type V CRISPR-Cas nuclease, such as Cas12a, Cas13a, or Cas14a. In some embodiments, the nucleic acid-guided nuclease is a Type I CRISPR-Cas nuclease, such as Cas3. Type II and Type VI nucleic acid-guided nucleases may also be employed.

In an RNP with a single crRNA (i.e., lacking/without a tracrRNA), Cas12a nucleases and related homologs and orthologs interact with a PAM (protospacer adjacent motif) sequence in a target nucleic acid for dsDNA unwinding and R-loop formation. Cas12a nucleases employ a multistep mechanism to ensure accurate recognition of spacer sequences in the target nucleic acid. The WED, REC1 and PAM-interacting (PI) domains of Cas12a nucleases are responsible for PAM recognition and for initiating invasion of the crRNA in the target dsDNA and for R-loop formation. It has been hypothesized that a conserved lysine residue is inserted into the dsDNA duplex, possibly initiating template strand/non-template strand unwinding. (See Jinek, et al, Mol. Cell, 73(3):589-600.e4 (2019).) PAM binding further introduces a kink in the target strand, which further contributes to local strand separation and facilitates base paring of the target strand to the seed segment of the crRNA while the displaced non-target strand is stabilized by interactions with the PAM-interacting domains. (Id.) The variant nucleic acid-guided nucleases disclosed herein and discussed in detail below have been engineered to disrupt one or both of the WED and PI domains to reconfigure the site of unwinding and R-loop formation to, e.g., sterically obstruct dsDNA target nucleic acids from binding to the variant nucleic acid-guided nuclease and/or to minimize strand separation and/or stabilization of the non-target strand. Though contrary to common wisdom, engineering the variant nucleic acid-guided nucleases in this way contributes to a robust and high-fidelity cascade assay.

The variant nucleic acid-guided nucleases disclosed herein are variants of wildtype Type V nucleases LbCas12a (Lachnospriaceae bacterium Cas12a), AsCas 12a (Acidaminococcus sp. BV3L6 Cas12a), CtCas12a (Candidatus Methanoplasma *termitum* Cas12a), EeCas12a (*Eubacterium eligens* Cas12a), Mb3Cas12a (*Moraxella* bovoculi Cas12a), FnCas12a (*Francisella novicida* Cas12a), FnoCas12a (*Francisella tularensis* subsp. *novicida* FTG Cas12a), FbCas12a (Flavobacteriales bacterium Cas12a), Lb4Cas12a (*Lachnospira eligens* Cas12a), MbCas12a (*Moraxella bovoculi* Cas12a), Pb2Cas12a (*Prevotella bryantii* Cas12a), PgCas12a (Candidatus Parcubacteria bacterium Cas12a), AaCas12a (Acidaminococcus sp. Cas12a), BoCas12a (Bacteroidetes bacterium Cas12a), CMaCas12a (Candidatus Methanomethylophilus alvus CMx1201 Cas12a), and to-be-discovered equivalent Cas12a nucleic acid-guided nucleases and homologs and orthologs of these nucleic acid-guided nucleases (and other nucleic acid-guided nucleases that exhibit both cis-cleavage and trans-cleavage activity), where mutations have been made to the PAM interacting domains such that double-stranded DNA (dsDNA) substrates are bound much more slowly to the variant nucleic acid-guided nucleases than to their wildtype nucleic acid-guided nuclease counterpart, yet single-stranded DNA (ssDNA) substrates are bound at the same rate or nearly so as their wildtype nucleic acid-guided nuclease counterpart. The variant nucleic acid-guided nucleases comprise reconfigured domains that interact with the PAM region or surrounding sequences on the blocked nucleic acid molecules to achieve this phenotype and are described in detail below.

Guide RNA (gRNA)

The present disclosure detects a target nucleic acid of interest via a reaction mixture containing at least two guide RNAs (gRNAs) each incorporated into a different RNP complex (i.e., RNP1 and RNP2). Suitable gRNAs include at least one crRNA region to enable specificity in every reaction. The gRNA of RNP1 is specific to a target nucleic acid of interest and the gRNA of RNP2 is specific to an unblocked nucleic acid or a synthesized activating molecule (both described in detail below). As will be clear given the description below, an advantageous feature of the cascade assay is that, with the exception of the gRNA in the RNP1 (i.e., the gRNA specific to the target nucleic acid of interest), the cascade assay components can stay the same (i.e., are identical or substantially identical) no matter what target nucleic acid(s) of interest are being detected, and the gRNA in RNP1 is easily reprogrammable.

Like the nucleic acid-guided nuclease, the gRNA may be provided in the cascade assay reaction mix in a preassembled RNP, as an RNA molecule, or may also be provided as a DNA sequence to be transcribed, in, e.g., a vector backbone. Providing the gRNA in a pre-assembled RNP complex (i.e., RNP1 or RNP2) is preferred if rapid kinetics are preferred. If provided as a gRNA molecule, the gRNA sequence may include multiple endoribonuclease recognition sites (e.g., Csy4) for multiplex processing. Alternatively, if provided as a DNA sequence to be transcribed, an endoribonuclease recognition site may be encoded between neighboring gRNA sequences such that more than one gRNA can be transcribed in a single expression cassette. Direct repeats can also serve as endoribonuclease recognition sites for multiplex processing. Guide RNAs are generally about 20 nucleotides to about 300 nucleotides in length and may contain a spacer sequence containing a plurality of bases and complementary to a protospacer sequence in the target sequence. The gRNA spacer sequence may be 50%, 60%, 75%, 80%, 85%, 90%, 95%, 97.5%, 98%, 99%, or more complementary to its intended target nucleic acid of interest.

The gRNA of RNP1 is capable of complexing with the nucleic acid-guided nuclease of RNP1 to perform cis-cleavage of a target nucleic acid of interest (e.g., a DNA or RNA), which triggers non-sequence specific trans-cleavage of other molecules in the reaction mix. Guide RNAs include any polynucleotide sequence having sufficient complementarity with a target nucleic acid of interest (or target sequences generated by unblocking blocked nucleic acid molecules or target sequences generated by synthesizing synthesized activating molecules as described below). Target nucleic acids of interest (describe in detail above) preferably include a protospacer-adjacent motif (PAM), and, following gRNA binding, the nucleic acid-guided nuclease induces a double-stranded break either inside or outside the protospacer region of the target nucleic acid of interest.

In some embodiments, the gRNA (e.g., of RNP1) is an exo-resistant circular molecule that can include several DNA bases between the 5' end and the 3' end of a natural guide RNA and is capable of binding a target sequence. The length of the circularized guide for RNP1 can be such that the circular form of guide can be complexed with a nucleic acid-guided nuclease to form a modified RNP1 which can still retain its cis-cleavage i.e., (specific) and trans-cleavage (i.e., non-specific) nuclease activity.

In any of the foregoing embodiments, the gRNA may be a modified or non-naturally occurring nucleic acid molecule. In some embodiments, the gRNAs of the disclosure may further contain a locked nucleic acid (LNA), a bridged nucleic acid (BNA), and/or a peptide nucleic acid (PNA). By way of further example, a modified nucleic acid molecule may contain a modified or non-naturally occurring nucleoside, nucleotide, and/or internucleoside linkage, such as a 2'-O-methyl (2'-O-Me) modified nucleoside, a 2'-fluoro (2'-F) modified nucleoside, and a phosphorothioate (PS) bond, or any other nucleic acid molecule modifications described herein.

Ribonucleoprotein (RNP) Complex

As described above, although the cascade assay "reaction mix" may comprise separate nucleic acid-guided nucleases and gRNAs (or coding sequences therefor), the cascade assays preferably comprise preassembled ribonucleoprotein complexes (RNPs) in the reaction mix, allowing for faster detection kinetics. The present cascade assay employs at least two types of RNP complexes—RNP1 and RNP2—each type containing a nucleic acid-guided nuclease and a gRNA. RNP1 and RNP2 may comprise the same nucleic acid-guided nuclease or may comprise different nucleic acid-guided nucleases; however, the gRNAs in RNP1 and RNP2 are different and are configured to detect different nucleic acids. In some embodiments, the reaction mixture contains about 1 fM to about 10 µM of a given RNP1, or about 1 µM to about 1 µM of a given RNP1, or about 10 µM to about 500 µM of a given RNP1. In some embodiments the reaction mixture contains about $6\times10^4$ to about $6\times10^{12}$ complexes per microliter (µl) of a given RNP1, or about $6\times10^6$ to about $6\times10^{10}$ complexes per microliter (µl) of a given RNP1. In some embodiments, the reaction mixture contains about 1 fM to about 500 µM of a given RNP2, or about 1 µM to about 250 µM of a given RNP2, or about 10 µM to about 100 µM of a given RNP2. In some embodiments the reaction mixture contains about $6\times10^4$ to about $6\times10^{12}$ complexes per microliter (µl) of a given RNP2 or about $6\times10^6$ to about $6\times10^{12}$ complexes per microliter (µl) of a given RNP2. See Example II below describing preassembling RNPs and Examples V and VI below describing various cascade assay conditions where the relative concentrations of RNP2 and the blocked nucleic acid molecules is adjusted as described below.

In any of the embodiments of the disclosure, the reaction mixture includes 1 to about 1,000 different RNP1s (e.g., 1, 2, 3, 4, 5, 6, 7, 8, 9, 10, 11, 12, 13, 14, 15, 16, 27, 28, 19, 20, 21, 22, 23, 24, 25, 50, 75, 100, 125, 150, 175, 200, 250, 300, 350, 400, 450, 500, 550, 600, 650, 700, 750, 800, 850, 900, 950, or 10,000 or more RNP1s), where different RNP1s comprise a different gRNA (or crRNA thereof) polynucleotide sequence. For example, a reaction mixture designed for environmental or oncology testing comprises more than one unique RNP1-gRNA (or RNP1-crRNA) ribonucleoprotein complex for the purpose of detecting more than one target nucleic acid of interest. That is, more than one RNP1 may also be present for the purpose of targeting one target nucleic acid of interest from many sources or for targeting more than one target nucleic acid of interest from a single source.

In any of the foregoing embodiments, the gRNA of RNP1 may be homologous or heterologous, relative to the gRNA of other RNP1(s) present in the reaction mixture. A homologous mixture of RNP1 gRNAs has a number of gRNAs with the same nucleotide sequence, whereas a heterologous mixture of RNP1 gRNAs has multiple gRNAs with different nucleotide sequences (e.g., gRNAs targeting different loci, genes, variants, and/or microbial species). Therefore, the disclosed methods of identifying one or more target nucleic acids of interest may include a reaction mixture containing more than two heterologous gRNAs, more than three heterologous gRNAs, more than four heterologous gRNAs, more than five heterologous gRNAs, more than six heterologous gRNAs, more than seven heterologous gRNAs, more than eight heterologous gRNAs, more than nine heterologous gRNAs, more than ten heterologous gRNAs, more than eleven heterologous gRNAs, more than twelve heterologous gRNAs, more than thirteen heterologous gRNAs, more than fourteen heterologous gRNAs, more than fifteen heterologous gRNAs, more than sixteen heterologous gRNAs, more than seventeen heterologous gRNAs, more than eighteen heterologous gRNAs, more than nineteen heterologous gRNAs, more than twenty heterologous gRNAs, more than twenty-one heterologous gRNAs, more than twenty-three heterologous gRNAs, more than twenty-four heterologous gRNAs, or more than twenty-five heterologous gRNAs. Such a heterologous mixture of RNP1 gRNAs in a single reaction enables multiplex testing.

As a first non-limiting example of a heterologous mixture of RNP1 gRNAs, the reaction mixture may contain: a number of RNP1s (RNP1-1s) having a gRNA targeting parainfluenza virus 1; a number of RNP1s (RNP1-2s) having a gRNA targeting human metapneumovirus; a number of RNP1s (RNP1-3s) having a gRNA targeting human rhinovirus; a number of RNP1s (RNP1-4s) having a gRNA targeting human enterovirus; and a number of RNP1s (RNP1-5s) having a gRNA targeting coronavirus HKU1. As a second non-limiting example of a heterologous mixture of RNP1 gRNAs, the reaction mixture may contain: a number of RNP1s containing a gRNA targeting two or more SARS-Co-V-2 variants, e.g., B.1.1.7, B.1.351, P.1, B.1.617.2, BA.1, BA.2, BA.2.12.1, BA.4, and BA.5 and subvariants thereof.

As another non-limiting example of a heterologous mixture of RNP1 gRNAs, the reaction mixture may contain RNP1s targeting two or more target nucleic acids of interest from organisms that infect grapevines, such as *Guignardia bidwellii* (RNP1-1), *Uncinula necator* (RNP1-2), *Botrytis cincerea* (RNP1-3), *Plasmopara viticola* (RNP1-4), and Botryotinis fuckleina (RNP1-5).

Reporter Moieties

The cascade assay detects a target nucleic acid of interest via detection of a signal generated in the reaction mix by a reporter moiety. In some embodiments the detection of the target nucleic acid of interest occurs virtually instantaneously. For example, see the results reported in Example VI for assays comprising 3e4 or 30 copies of MRSA target and within 1 minute or less at 3 copies of MRSA target (see, e.g., FIGS. 10B-10H). Reporter moieties can comprise DNA, RNA, a chimera of DNA and RNA, and can be single stranded, double stranded, or a moiety that is a combination of single stranded portions and double stranded portions.

Depending on the type of reporter moiety used, trans- and/or cis-cleavage by the nucleic acid-guided nuclease in RNP2 releases a signal. In some embodiments, trans-cleavage of stand-alone reporter moieties (e.g., not bound to any blocked nucleic acid molecules or blocked primer molecules) may generate signal changes at rates that are proportional to the cleavage rate, as new RNP2s are activated over time (shown in FIG. 1B and at top of FIG. 4). Trans-cleavage by either an activated RNP1 or an activated RNP2 may release a signal. In alternative embodiments and preferably, the reporter moiety may be bound to the blocked nucleic acid molecule, where trans-cleavage of the blocked nucleic acid molecule (or blocked primer molecule) and conversion to an unblocked nucleic acid molecule (or unblocked primer molecule) may generate signal changes at rates that are proportional to the cleavage rate, as new RNP2s are activated over time, thus allowing for real time reporting of results (shown at FIG. 4, center). In yet another embodiment, the reporter moiety may be bound to a blocked nucleic acid molecule such that cis-cleavage following the binding of the RNP2 to an unblocked nucleic acid molecule releases a PAM distal sequence, which in turn generates a signal at rates that are proportional to the cleavage rate (shown at FIG. 4, bottom). In this case, activation of RNP2 by cis- (target specific) cleavage of the unblocked nucleic acid molecule directly produces a signal, rather than producing a signal via indiscriminate trans-cleavage activity. Alternatively or in addition, a reporter moiety may be bound to the gRNA.

The reporter moiety may be a synthetic molecule linked or conjugated to a reporter and quencher such as, for example, a TaqMan probe with a dye label (e.g., FAM or FITC) on the 5' end and a quencher on the 3' end. The reporter and quencher may be about 20-30 bases apart or less (i.e., 10-11 nm apart or less) for effective quenching via fluorescence resonance energy transfer (FRET). Alternatively, signal generation may occur through different mechanisms. Other detectable moieties, labels, or reporters can also be used to detect a target nucleic acid of interest as described herein. Reporter moieties can be labeled in a variety of ways, including direct or indirect attachment of a detectable moiety such as a fluorescent moiety, hapten, or colorimetric moiety.

Examples of detectable moieties include various radioactive moieties, enzymes, prosthetic groups, fluorescent markers, luminescent markers, bioluminescent markers, metal particles, and protein-protein binding pairs, e.g., protein-antibody binding pairs. Examples of fluorescent moieties include, but are not limited to, yellow fluorescent protein (YFP), green fluorescence protein (GFP), cyan fluorescence protein (CFP), umbelliferone, fluorescein, fluorescein isothiocyanate, rhodamine, dichlorotriazinylamine fluorescein, cyanines, dansyl chloride, phycocyanin, and phycoerythrin. Examples of bioluminescent markers include, but are not limited to, luciferase (e.g., bacterial, firefly, click beetle and the like), luciferin, and aequorin. Examples of enzyme systems having visually detectable signals include, but are not limited to, galactosidases, glucuronidases, phosphatases, peroxidases, and cholinesterases. Identifiable markers also include radioactive elements such as $^{125}I$, $^{35}S$, $^{14}C$, or $^{3}H$. Reporters can also include a change in pH or charge of the cascade assay reaction mix.

The methods used to detect the generated signal will depend on the reporter moiety or moieties used. For example, a radioactive label can be detected using a scintillation counter, photographic film as in autoradiography, or storage phosphor imaging. Fluorescent labels can be detected by exciting the fluorochrome with the appropriate wavelength of light and detecting the resulting fluorescence. The fluorescence can be detected visually, by means of photographic film, by the use of electronic detectors such as charge coupled devices (CCDs) or photomultipliers and the like. Enzymatic labels can be detected by providing the appropriate substrates for the enzyme and detecting the resulting reaction product. Simple colorimetric labels can be detected by observing the color associated with the label. When pairs of fluorophores are used in an assay, fluorophores are chosen that have distinct emission patterns (wavelengths) so that they can be easily distinguished. In some embodiments, the signal can be detected by lateral flow assays (LFAs). Lateral flow tests are simple devices intended to detect the presence or absence of a target nucleic acid of interest in a sample. LFAs can use nucleic acid molecules conjugated nanoparticles (often gold, e.g., RNA-AuNPs or DNA-AuNPs) as a detection probe, which hybridizes to a complementary target sequence. (See FIG. 9 and the description thereof below.) The classic example of an LFA is the home pregnancy test.

Single-stranded, double-stranded or reporter moieties comprising both single- and double-stranded portions can be introduced to show a signal change proportional to the cleavage rate, which increases with every new activated RNP2 complex over time. In some embodiments and as described in detail below, reporter moieties can also be embedded into the blocked nucleic acid molecules (or blocked primer molecules) for real time reporting of results.

For example, the method of detecting a target nucleic acid molecule in a sample using a cascade assay as described herein can involve contacting the reaction mix with a labeled detection ssDNA containing a fluorescent resonance energy transfer (FRET) pair, a quencher/phosphor pair, or both. A FRET pair consists of a donor chromophore and an acceptor chromophore, where the acceptor chromophore may be a quencher molecule. FRET pairs (donor/acceptor) suitable for use include, but are not limited to, EDANS/fluorescein, IAEDANS/fluorescein, fluorescein/tetramethylrhodamine, fluorescein/Cy 5, IEDANS/DABCYL, fluorescein/QSY-7, fluorescein/LC Red 640, fluorescein/Cy 5.5, Texas Red/DABCYL, BODIPY/DABCYL, Lucifer yellow/DABCYL, coumarin/DABCYL, and fluorescein/LC Red 705. In addition, a fluorophore/quantum dot donor/acceptor pair can be used. EDANS is (5-((2-Aminoethyl)amino)naphthalene-1-sulfonic acid); IAEDANS is 5-({2-[(iodoacetyl)amino]ethyl}amino)naphthalene-1-sulfonic acid); DABCYL is 4-(4-dimethylaminophenyl)diazenylbenzoic acid. Useful quenchers include, but are not limited to, BHQ, DABCYL, QSY 7 and QSY 33.

In any of the foregoing embodiments, the reporter moiety may comprise one or more modified nucleic acid molecules, containing a modified nucleoside or nucleotide. In some embodiments the modified nucleoside or nucleotide is chosen from 2'-O-methyl (2'-O-Me) modified nucleoside, a 2'-fluoro (2'-F) modified nucleoside, and a phosphorothioate (PS) bond, or any other nucleic acid molecule modifications described below.

Nucleic Acid Modifications

For any of the nucleic acid molecules described herein (e.g., blocked nucleic acid molecules, blocked primer molecules, gRNAs, template molecules, synthesized activating molecules, and reporter moieties), the nucleic acid molecules may be used in a wholly or partially modified form. Typically, modifications to the blocked nucleic acid molecules, gRNAs, template molecules, reporter moieties, and blocked primer molecules described herein are introduced to optimize the molecule's biophysical properties (e.g., increasing nucleic acid-guided nuclease resistance and/or increasing thermal stability). Modifications typically are achieved by the incorporation of, for example, one or more alternative nucleosides, alternative sugar moieties, and/or alternative internucleoside linkages.

For example, one or more of the cascade assay components may include one or more of the following nucleoside modifications: 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl (—C≡C—CH$_3$) uracil and cytosine and other alkynyl derivatives of pyrimidine bases, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 2-F-adenine, 2-amino-adenine, 8-azaguanine and 8-azaadenine, 7-deazaguanine and 7-deazaadenine, and/or 3-deazaguanine and 3-deazaadenine. The nucleic acid molecules described herein (e.g., blocked nucleic acid molecules, blocked primer molecules, gRNAs, reporter molecules, synthesized activating molecules, and template molecules) may also include nucleobases in which the purine or pyrimidine base is replaced with other heterocycles, for example 7-deaza-adenine, 7-deazaguanosine, 2-aminopyridine, and/or 2-pyridone. Further modification of the nucleic acid molecules described herein may include nucleobases disclosed in U.S. Pat. No. 3,687,808; Kroschwitz, ed., *The Concise Encyclopedia of Polymer Science and Engineering*, NY, John Wiley & Sons, 1990, pp. 858-859; Englisch, et al., Angewandte Chemie, 30:613 (1991); and Sanghvi, Chapter 16, Antisense Research and Applications, CRC Press, Gait, ed., 1993, pp. 289-302.

In addition to or as an alternative to nucleoside modifications, the cascade assay components may comprise 2' sugar modifications, including 2'-O-methyl (2'-O-Me), 2'-methoxyethoxy (2'-O—CH$_2$CH$_2$OCH$_3$, also known as 2'-O-(2-methoxyethyl) or 2'-MOE), 2'-dimethylaminooxyethoxy, i.e., a O(CH$_2$)$_2$ON(CH$_3$)$_2$ group, also known as 2'-DMAOE, and/or 2'-dimethylaminoethoxyethoxy (also known in the art as 2'-O-dimethylamino-ethoxy-ethyl or 2'-DMAEOE), i.e., 2'-O—CH$_2$OCH$_2$N(CH$_3$)$_2$. Other possible 2'-modifications that can modify the nucleic acid molecules described herein (i.e., blocked nucleic acid molecules, gRNAs, synthesized activating molecules, reporter molecules, and blocked primer molecules) may include all possible orientations of OH; F; O-, S-, or N-alkyl (mono- or di-); O-, S-, or N-alkenyl (mono- or di-); O-, S- or N-alkynyl (mono- or di-); or O-alkyl-O-alkyl, wherein the alkyl, alkenyl and alkynyl may be substituted or unsubstituted C1 to C10 alkyl or C2 to C10 alkenyl and alkynyl. Other potential sugar substituent groups include, e.g., aminopropoxy (—OCH$_2$CH$_2$CH$_2$NH$_2$), allyl (—CH$_2$—CH═CH$_2$), —O-allyl (—O—CH$_2$—CH═CH$_2$) and fluoro (F). 2'-sugar substituent groups may be in the arabino (up) position or ribo (down) position. In some embodiments, the 2'-arabino modification is 2'-F. Similar modifications may also be made at other positions on the interfering RNA molecule, particularly the 3' position of the sugar on the 3' terminal nucleoside or in 2'-5' linked oligonucleotides and the 5' position of 5' terminal nucleotide. Oligonucleotides may also have sugar mimetics such as cyclobutyl moieties in place of the pentofuranosyl sugar.

Finally, modifications to the cascade assay components may comprise internucleoside modifications such as phosphorothioates, phosphorodithioates, phosphotriesters, aminoalkylphosphotriesters, methyl and other alkyl phosphonates including 3'-alkylene phosphonates, 5'-alkylene phosphonates, phosphinates, phosphoramidates including 3'-amino phosphoramidate and aminoalkylphosphoramidates, thionophosphoramidates, thionoalkylphosphonates, thionoalkylphosphotriesters, selenophosphates, and boranophosphates having normal 3'-5' linkages, 2'-5' linked analogs of these, and those having inverted polarity wherein one or more internucleotide linkages is a 3' to 3', 5' to 5' or 2' to 2' linkage.

The Signal Boosting Cascade Assay Employing Blocked Nucleic Acid Molecules

Figure 2A:
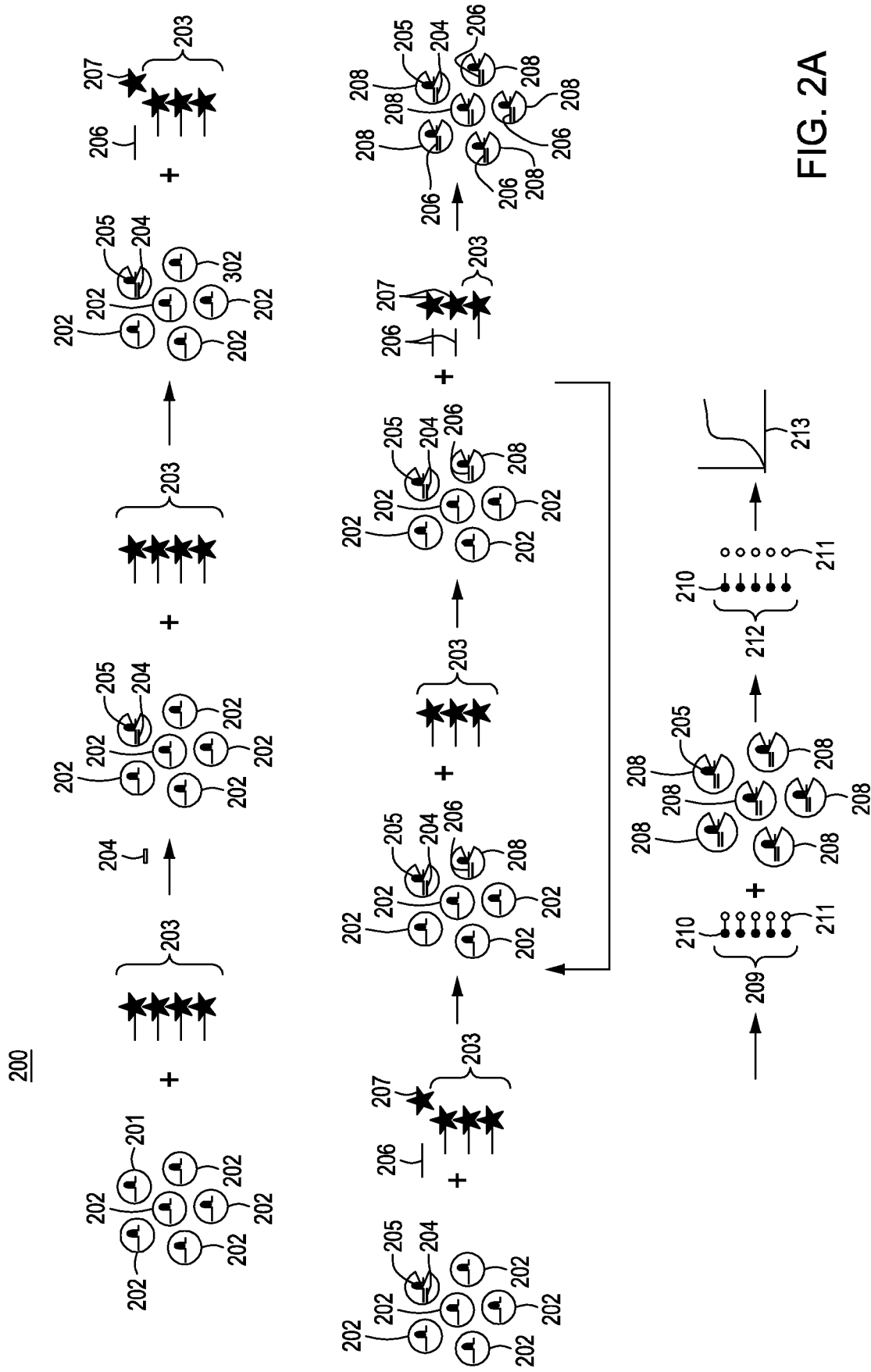
FIG. 2A is a diagram showing the sequence of steps in an exemplary cascade assay utilizing blocked nucleic acid molecules.

Before getting to the details relating to addressing undesired unwinding of the blocked nucleic acid molecules (or blocked primer molecules), understanding the cascade assay itself is key. FIG. 1B, described above, depicts the cascade assay generally. A specific embodiment of the cascade assay utilizing blocked nucleic acid molecules is depicted in FIG. 2A and described in detail below. In this embodiment, a blocked nucleic acid is used to prevent the activation of RNP2 in the absence of a target nucleic acid of interest. The method in FIG. 2A begins with providing the cascade assay components RNP1 (201), RNP2 (202) and blocked nucleic acid molecules (203). RNP1 (201) comprises a gRNA specific for a target nucleic acid of interest and a nucleic acid-guided nuclease (e.g., Cas 12a or Cas 14 for a DNA target nucleic acid of interest or a Cas 13a for an RNA target nucleic acid of interest) and RNP2 (202) comprises a gRNA specific for an unblocked nucleic acid molecule and a nucleic acid-guided nuclease (again, e.g., Cas 12a or Cas 14 for a DNA unblocked nucleic acid molecule or a Cas 13a for an RNA unblocked nucleic acid molecule). As described above, the nucleic acid-guided nucleases in RNP1 (201) and RNP2 (202) can be the same or different depending on the type of target nucleic acid of interest and unblocked nucleic acid molecule. What is key, however, is that the nucleic acid-guided nucleases in RNP1 and RNP2 may be activated to have trans-cleavage activity following initiation of cis-cleavage activity.

In a first step, a sample comprising a target nucleic acid of interest (204) is added to the cascade assay reaction mix. The target nucleic acid of interest (204) combines with and activates RNP1 (205) but does not interact with or activate RNP2 (202). Once activated, RNP1 binds the target nucleic acid of interest (204) and cuts the target nucleic acid of interest (204) via sequence-specific cis-cleavage, activating non-specific trans-cleavage of other nucleic acids present in the reaction mix, including the blocked nucleic acid molecules (203). At least one of the blocked nucleic acid molecules (203) becomes an unblocked nucleic acid molecule (206) when the blocking moiety (207) is removed. As described below, "blocking moiety" may refer to nucleoside modifications, topographical configurations such as secondary structures, and/or structural modifications.

Once at least one of the blocked nucleic acid molecules (203) is unblocked, the unblocked nucleic acid molecule (206) can then bind to and activate an RNP2 (208). Because the nucleic acid-guided nucleases in the RNP1s (205) and RNP2s (208) have both cis- and trans-cleavage activity, the trans-cleavage activity causes more blocked nucleic acid molecules (203) become unblocked nucleic acid molecules (206) triggering activation of even more RNP2s (208) and more trans-cleavage activity in a cascade. FIG. 2A at bottom depicts the concurrent activation of reporter moieties. Intact reporter moieties (209) comprise a quencher (210) and a fluorophore (211) linked by a nucleic acid sequence. As described above in relation to FIG. 1B, the reporter moieties are also subject to trans-cleavage by activated RNP1 (205) and RNP2 (208). The intact reporter moieties (209) become activated reporter moieties (212) when the quencher (210) is separated from the fluorophore (211), emitting a fluorescent signal (213). Signal strength increases rapidly as more blocked nucleic acid molecules (203) become unblocked nucleic acid molecules (206) triggering cis-cleavage activity of more RNP2s (208) and thus more trans-cleavage activity of the reporter moieties (209). Again, the reporter moieties are shown here as separate molecules from the blocked nucleic acid molecules, but other configurations may be employed and are discussed in relation to FIG. 4. One particularly advantageous feature of the cascade assay is that, with the exception of the gRNA in the RNP1 (gRNA1), the cascade assay components are modular in the sense that the components stay the same no matter what target nucleic acid(s) of interest are being detected.

Figure 2B:
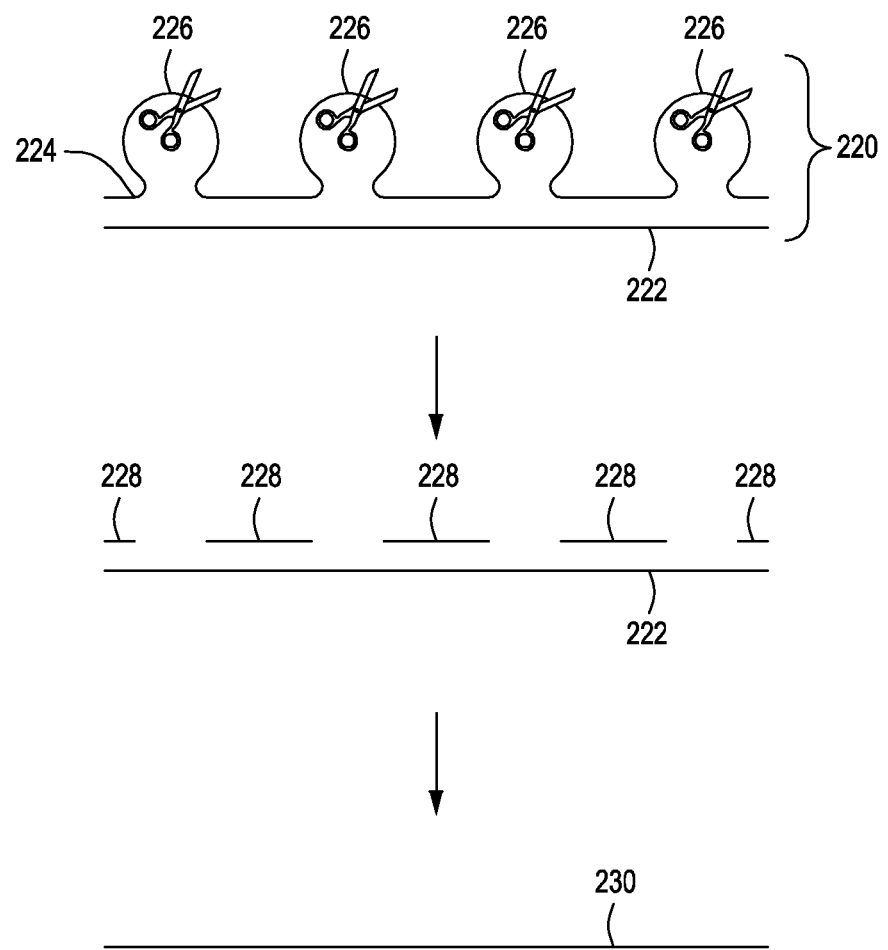
FIG. 2B is a diagram showing an exemplary blocked nucleic acid molecule and a method for unblocking the blocked nucleic acid molecules of the disclosure.

FIG. 2B is a diagram showing an exemplary blocked nucleic acid molecule (220) and an exemplary technique for unblocking the blocked nucleic acid molecules described herein. A blocked single-stranded or double-stranded, circular or linear, DNA or RNA molecule (220) comprising a target strand (222) may contain a partial hybridization with a complementary non-target strand nucleic acid molecule (224) containing unhybridized and cleavable secondary loop structures (226) (e.g., hairpin loops, tetraloops, pseudoknots, junctions, kissing hairpins, internal loops, bulges, and multibranch loops). Trans-cleavage of the loops by, e.g., activated RNP1s or RNP2s, generates short strand nucleotide sequences or regions (228) which, because of the short length and low melting temperature $T_m$ can dehybridize at room temperature (e.g., 15°-25° C.), thereby unblocking the blocked nucleic acid molecule (220) to create an unblocked nucleic acid molecule (230), enabling the internalization of the unblocked nucleic acid molecule (230) (target strand) into an RNP2, leading to RNP2 activation.

Figure 2C:
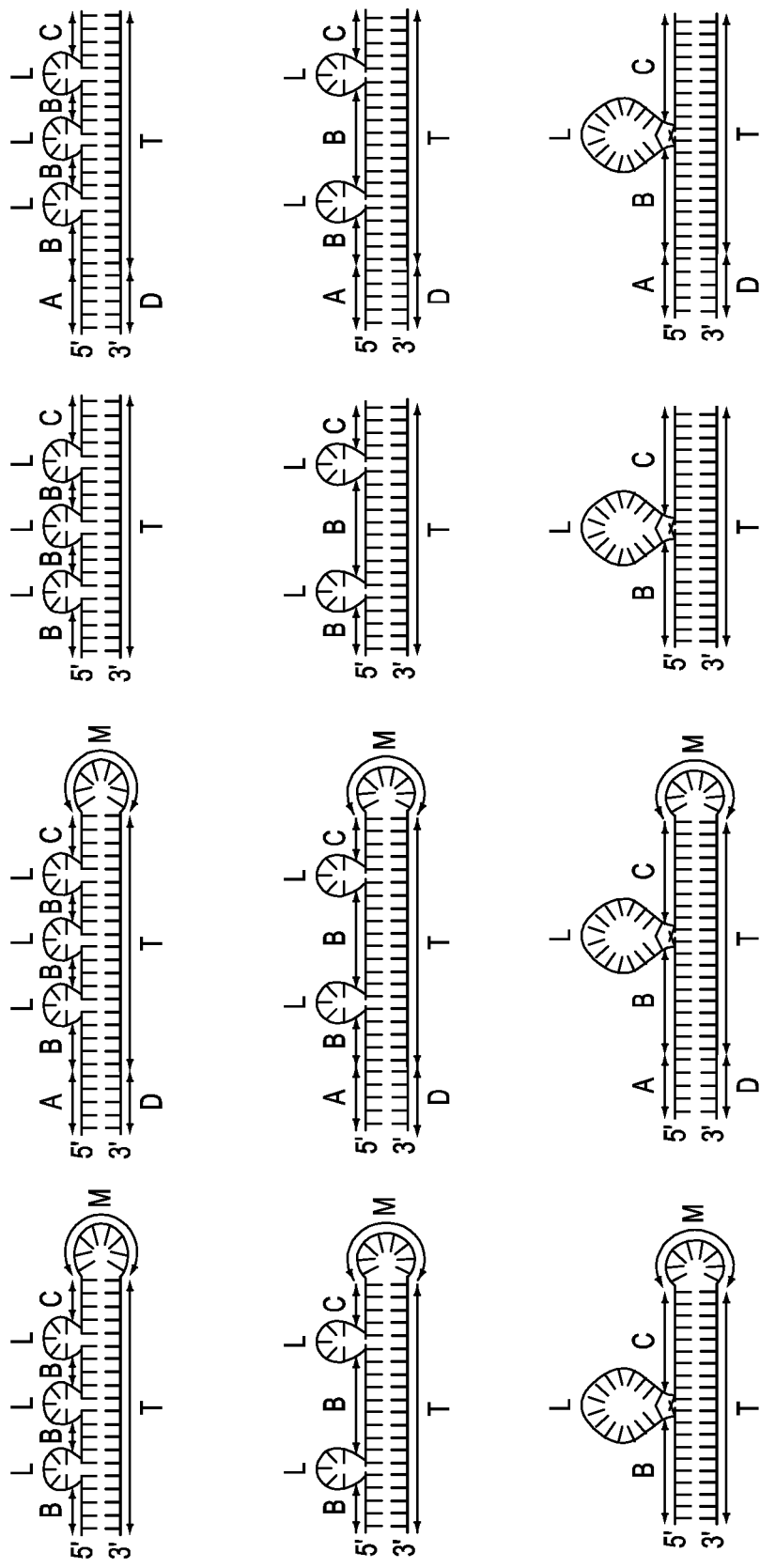
FIG. 2C shows schematics of several exemplary blocked nucleic acid molecules containing the structure of Formula I, as described herein.
Figure 2D:
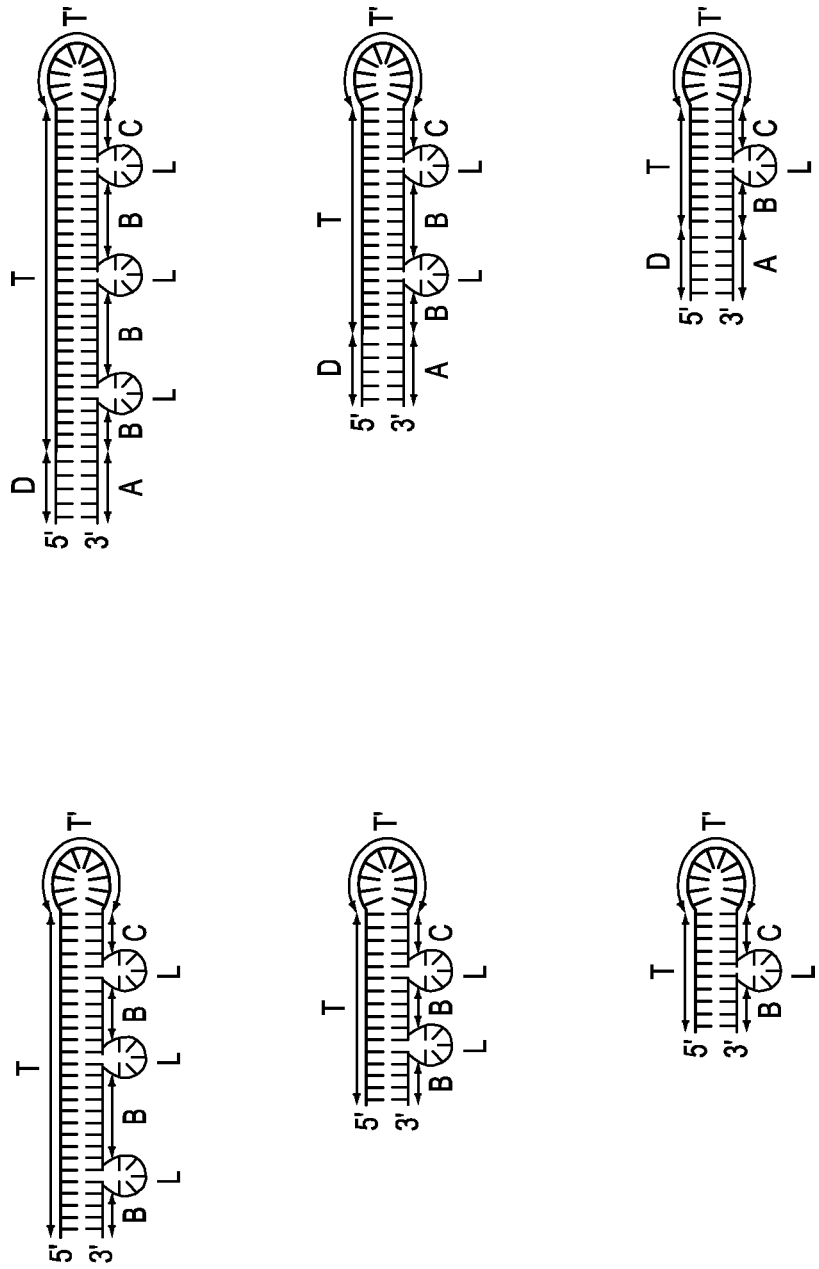
FIG. 2D shows schematics of several exemplary blocked nucleic acid molecules containing the structure of Formula II, as described herein.

A blocked nucleic acid molecule may be single-stranded or double-stranded, circular or linear, and may further contain a partially hybridized nucleic acid sequence containing cleavable secondary loop structures, as exemplified by "L" in FIGS. 2C-2E. Such blocked nucleic acid molecules typically have a low binding affinity, or high dissociation constant ($K_d$) in relation to binding to RNP2 and may be referred to herein as a high $K_d$ nucleic acid molecule. In the context of the present disclosure, the binding of blocked or unblocked nucleic acid molecules or blocked or unblocked primer molecules to RNP2, low $K_d$ values range from about 100 fM to about 1 aM or lower (e.g., 100 zM) and high $K_d$ values are in the range of 100 nM to about 10-100 10 mM and thus are about $10^5$-$10^6$-, $10^7$-, $10^8$-, $10^9$- to $10^{10}$-fold or higher as compared to low $K_d$ values. Of course, the ideal blocked nucleic acid molecule would have an "infinite $K_d$."

The blocked nucleic acid molecules (high $K_d$ molecules) described herein can be converted into unblocked nucleic acid molecules (low $K_d$ molecules—also in relation to binding to RNP2) via cleavage of nuclease-cleavable regions (e.g., via active RNP1s and RNP2s). The unblocked nucleic acid molecule has a higher binding affinity for the gRNA in RNP2 than does the blocked nucleic acid molecule, although, as described below, there is some "leakiness" where some blocked nucleic acid molecules are able to interact with the gRNA in the RNP2 triggering undesired unwinding.

Once the unblocked nucleic acid molecule is bound to RNP2, the RNP2 activation triggers trans-cleavage activity, which in turn leads to more RNP2 activation by further cleaving blocked nucleic acid molecules, resulting in a positive feedback loop or cascade.

In embodiments where blocked nucleic acid molecules are linear and/or form a secondary structure, the blocked nucleic acid molecules may be single-stranded (ss) or double-stranded (ds) and contain a first nucleotide sequence and a second nucleotide sequence. The first nucleotide sequence has sufficient complementarity to hybridize to a gRNA of RNP2, and the second nucleotide sequence does not. The first and second nucleotide sequences of a blocked nucleic acid molecule may be on the same nucleic acid molecule (e.g., for single-strand embodiments) or on separate nucleic acid molecules (e.g., for double-strand embodiments). Trans-cleavage (e.g., via RNP1 or RNP2) of the second nucleotide sequence converts the blocked nucleic acid molecule to a single-strand unblocked nucleic acid molecule. The unblocked nucleic acid molecule contains only the first nucleotide sequence, which has sufficient complementarity to hybridize to the gRNA of RNP2, thereby activating the trans-cleavage activity of RNP2.

In some embodiments, the second nucleotide sequence at least partially hybridizes to the first nucleotide sequence, resulting in a secondary structure containing at least one loop (e.g., hairpin loops, tetraloops, pseudoknots, junctions, kissing hairpins, internal loops, bulges, and multibranch loops). Such loops block the nucleic acid molecule from binding or incorporating into an RNP complex thereby initiating cis- or trans-cleavage (see, e.g., the exemplary structures in FIGS. 2C-2F).

Figure 2G:
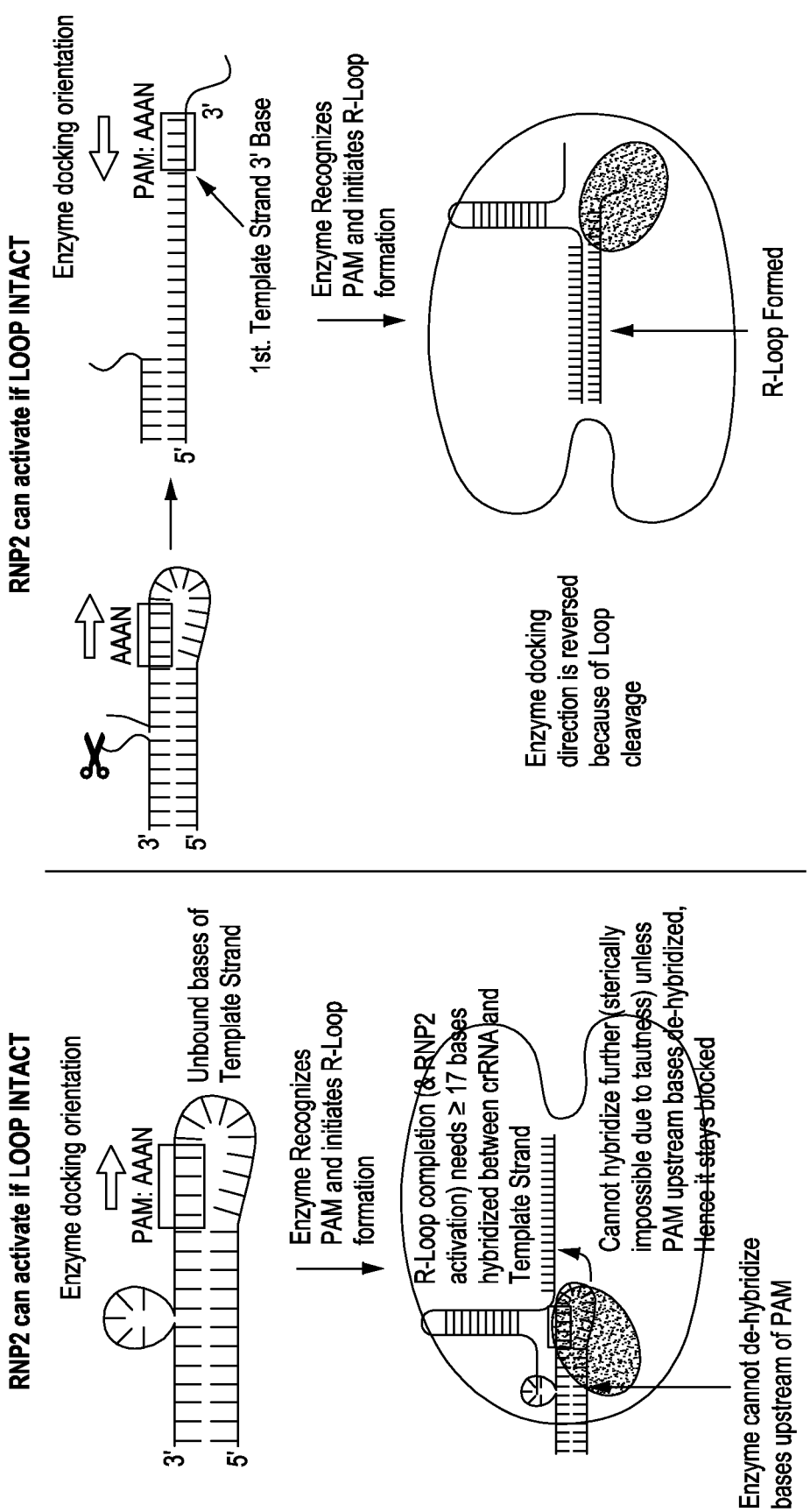
FIG. 2G shows an exemplary single-stranded blocked nucleic acid molecule with a design able to block R-loop formation with an RNP complex, thereby blocking activation of the trans-nuclease activity of an RNP complex (i.e., RNP2).

In some embodiments, the blocked nucleic acid molecule may contain a protospacer adjacent motif (PAM) sequence, or partial PAM sequence, positioned between the first and second nucleotide sequences, where the first sequence is 5' to the PAM sequence, or partial PAM sequence, (see FIG. 2G). Inclusion of a PAM sequence may increase the reaction kinetics internalizing the unblocked nucleic acid molecule into RNP2 and thus decrease the time to detection. In other embodiments, the blocked nucleic acid molecule does not contain a PAM sequence.

In some embodiments, the blocked nucleic acid molecules (i.e., high $K_d$ nucleic acid molecules in relation to binding to RNP2) of the disclosure may include a structure represented by Formula I (e.g., FIG. 2C), Formula II (e.g., FIG. 2D), Formula III (e.g., FIG. 2E), or Formula IV (e.g., FIG. 2F) wherein Formulas I-IV are in the 5'-to-3' direction:

A-(B-L)J-C-M-T-D        (Formula I);

wherein A is 0-15 nucleotides in length;
B is 4-12 nucleotides in length;
L is 3-25 nucleotides in length;
J is an integer between 1 and 10;
C is 4-15 nucleotides in length;
M is 1-25 nucleotides in length or is absent, wherein if M is absent then A-(B-L)J-C and T-D are separate nucleic acid strands;
T is 17-135 nucleotides in length (e.g., 17-100, 17-50, or 17-25) and comprises a sequence complementary to B and C; and
D is 0-10 nucleotides in length and comprises a sequence complementary to A;

D-T-T'-C-(L-B)J-A                (Formula II);

wherein D is 0-10 nucleotides in length;
T-T' is 17-135 nucleotides in length (e.g., 17-100, 17-50, or 17-25);
T' is 1-10 nucleotides in length and does not hybridize with T;
C is 4-15 nucleotides in length and comprises a sequence complementary to T;
L is 3-25 nucleotides in length and does not hybridize with T;
B is 4-12 nucleotides in length and comprises a sequence complementary to T;
J is an integer between 1 and 10;
A is 0-15 nucleotides in length and comprises a sequence complementary to D;

T-D-M-A-(B-L)J-C (Formula III);

wherein T is 17-135 nucleotides in length (e.g., 17-100, 17-50, or 17-25);
D is 0-10 nucleotides in length;
M is 1-25 nucleotides in length or is absent, wherein if M is absent then T-D and A-(B-L)J-C are separate nucleic acid strands;
A is 0-15 nucleotides in length and comprises a sequence complementary to D;
B is 4-12 nucleotides in length and comprises a sequence complementary to T;
L is 3-25 nucleotides in length;
J is an integer between 1 and 10; and
C is 4-15 nucleotides in length;

T-D-M-A-$L_p$-C (Formula IV);

wherein T is 17-31 nucleotides in length (e.g., 17-100, 17-50, or 17-25);
D is 0-15 nucleotides in length;
M is 1-25 nucleotides in length;
A is 0-15 nucleotides in length and comprises a sequence complementary to D; and
L is 3-25 nucleotides in length;
p is 0 or 1;
C is 4-15 nucleotides in length and comprises a sequence complementary to T.

In alternative embodiments of any of these molecules, T (or T-T') can have a maximum length of 1,000 nucleotides, e.g., at most 750, at most 500, at most 400, at more 300, at most 250, at most 200, at most 150, at most 135, at most 100, at most 75, at most 50, or at most 25 nucleotides.

Nucleotide mismatches can be introduced in any of the above structures containing double-strand segments (for example, where M is absent in Formula I or Formula III) to reduce the melting temperature ($T_m$) of the segment such that once the loop (L) is cleaved, the double-strand segment is unstable and dehybridizes rapidly. The percentage of nucleotide mismatches of a given segment may vary between 0% and 50%; however, the maximum number of nucleotide mismatches is limited to a number where the secondary loop structure still forms. "Segments" in the above statement refers to A, B, and C. In other words, the number of hybridized bases can be less than or equal to the length of each double-strand segment and vary based on number of mismatches introduced.

In any blocked nucleic acid molecule having the structure of Formula I, III, or IV, T will have sequence complementarity to a nucleotide sequence (e.g., a spacer sequence) within a gRNA of RNP2. The nucleotide sequence of T is to be designed such that hybridization of T to the gRNA of RNP2 activates the trans-nuclease activity of RNP2. In any blocked nucleic acid molecule having structure of Formula II, T-T' will have sequence complementarity to a sequence (e.g., a spacer sequence) within the gRNA of RNP2. The nucleotide sequence of T-T' is to be designed such that hybridization of T-T' to the gRNA of RNP2 activates the trans-nuclease activity of RNP2. For T or T-T', full complementarity to the gRNA is not necessarily required, provided there is sufficient complementarity to cause hybridization and trans-cleavage activation of RNP2.

In any of the foregoing embodiments, the blocked nucleic acid molecules of the disclosure may and preferably do further contain a reporter moiety attached thereto such that cleavage of the blocked nucleic acid releases a signal from the reporter moiety. (See FIG. 4, mechanisms depicted at center and bottom.)

Also, in any of the foregoing embodiments, the blocked nucleic acid molecule may be a modified or non-naturally occurring nucleic acid molecule. In some embodiments, the blocked nucleic acid molecules of the disclosure may further contain a locked nucleic acid (LNA), a bridged nucleic acid (BNA), and/or a peptide nucleic acid (PNA). The blocked nucleic acid molecule may contain a modified or non-naturally occurring nucleoside, nucleotide, and/or internucleoside linkage, such as a 2'-O-methyl (2'-O-Me) modified nucleoside, a 2'-fluoro (2'-F) modified nucleoside, and a phosphorothioate (PS) bond, any other nucleic acid molecule modifications described above, and any combination thereof.

FIG. 2G at left shows an exemplary single-strand blocked nucleic acid molecule and how the configuration of this blocked nucleic acid molecule is able to prevent (or significantly prevent) undesired unwinding of the blocked nucleic acid molecule (or blocked primer molecule) and R-loop formation with an RNP complex, thereby blocking activation of the trans-cleavage activity of RNP2. The single-strand blocked nucleic acid molecule is self-hybridized and comprises: a target strand (TS) sequence complementary to the gRNA (e.g., crRNA) of RNP2; a cleavable non-target strand (NTS) sequence that is partially hybridized (e.g., it contains secondary loop structures) to the TS sequence; and a protospacer adjacent motif (PAM) sequence (e.g., 5' NAAA 3') that is specifically located at the 3' end of the TS sequence. An RNP complex with 3'→5' diffusion (e.g., 1D diffusion) initiates R-loop formation upon PAM recognition. R-loop formation is completed upon a stabilizing ≥17 base hybridization of the TS to the gRNA of RNP2; however, because of the orientation of the PAM sequence relative to the secondary loop structure(s), the blocked nucleic acid molecule sterically prevents the target strand from hybridizing with the gRNA of RNP2, thereby blocking the stable R-loop formation required for the cascade reaction.

FIG. 2G at right shows the blocked nucleic acid molecule being unblocked via trans-cleavage (e.g., by RNP1) and subsequent dehybridization of the non-target strand's secondary loop structures, followed by binding of the target strand to the gRNA of RNP2, thereby completing stable R-loop formation and activating the trans-cleavage activity of the RNP2 complex.

In some embodiments, the blocked nucleic acid molecules provided herein are circular DNAs, RNAs or chimeric (DNA-RNA) molecules (FIG. 2H), and the blocked nucleic acid molecules may include different base compositions depending on the Cas enzyme used for RNP1 and RNP2. For the circular design of blocked nucleic acid molecules, the 5' and 3' ends are covalently linked together. This configuration makes internalization of the blocked nucleic acid molecule into RNP2—and subsequent RNP2 activation—sterically unfavorable, thereby blocking the progression of the cascade assay. Thus, RNP2 activation (e.g., trans-cleavage activity) happens after cleavage of a portion of the blocked nucleic acid molecule followed by linearization and internalization of unblocked nucleic acid molecule into RNP2.

In some embodiments, the blocked nucleic acid molecules are topologically circular molecules with 5' and 3' portions hybridized to each other using DNA, RNA, LNA, BNA, or PNA bases which have a very high melting temperature (Tm). The high Tm causes the structure to effectively behave as a circular molecule even though the 5' and 3' ends are not covalently linked. The 5' and 3' ends can also have base non-naturally occurring modifications such as phosphorothioate bonds to provide increased stability.

Figure 2H:
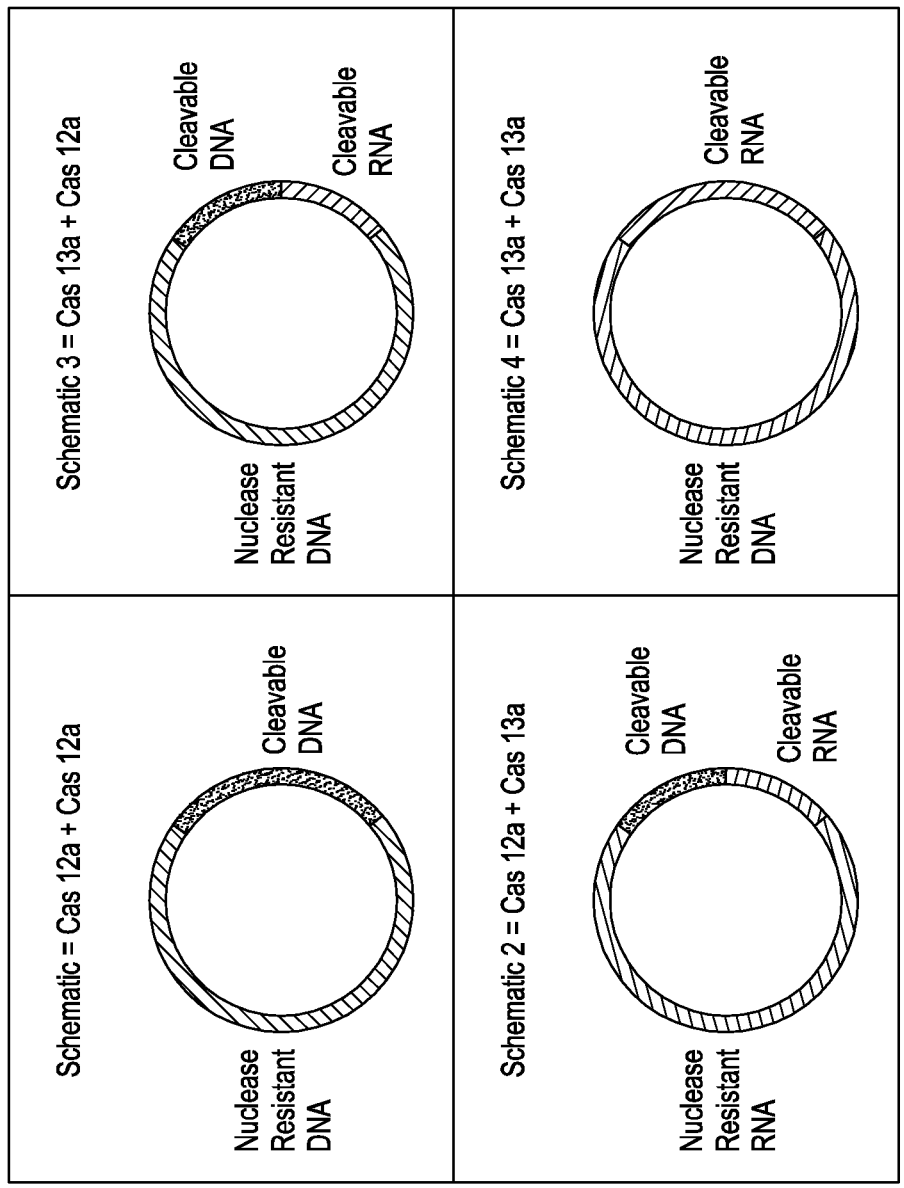
FIG. 2H shows schematics of exemplary circularized blocked nucleic acid molecules.

In embodiments where the blocked nucleic acid molecules are circularized (e.g., circular or topologically circular), as illustrated in FIG. 2H, each blocked nucleic acid molecule includes a first region, which is a target sequence specific to the gRNA of RNP2, and a second region, which is a sequence that can be cleaved by nuclease enzymes of activated RNP1 and/or RNP2. The first region may include a nuclease-resistant nucleic acid sequence such as, for example, a phosphorothioate group or other non-naturally occurring nuclease-resistant base modifications, for protection from trans-nucleic acid-guided nuclease activity. In some embodiments, when the Cas enzyme in both RNP1 and RNP2 is Cas12a, the first region of the blocked nucleic acid molecule includes a nuclease-resistant DNA sequence, and the second region of the blocked nucleic acid molecule includes a cleavable DNA sequence. In other embodiments, when the Cas enzyme in RNP1 is Cas12a and the Cas enzyme in RNP2 is Cas13a, the first region of the blocked nucleic acid molecule includes a nuclease-resistant RNA sequence, and the second region of the blocked nucleic acid molecule includes a cleavable DNA sequence and a cleavable RNA sequence. In yet other embodiments, when the Cas enzyme in RNP1 is Cas13a and the Cas enzyme in RNP2 is Cas12a, the first region of the blocked nucleic acid molecule includes a nuclease-resistant DNA sequence, and the second region of the blocked nucleic acid molecule includes a cleavable DNA sequence and a cleavable RNA sequence. In some other embodiments, when the Cas enzyme in both RNP1 and RNP2 is Cas13a, the first region of the blocked nucleic acid molecule includes a nuclease-resistant RNA sequence, and the second region of the blocked nucleic acid molecule includes a cleavable RNA sequence.

The Signal Boosting Cascade Assay Employing Blocked Primer Molecules

The blocked nucleic acid molecules described above may also be blocked primer molecules. Blocked primer molecules include a sequence complementary to a primer binding domain (PBD) on a template molecule (see description below in reference to FIGS. 3A and 3B) and can have the same general structures as the blocked nucleic acid molecules described above. A PBD serves as a nucleotide sequence for primer hybridization followed by primer polymerization by a polymerase. In any of Formulas I, II, or III described above, the blocked primer nucleic acid molecule may include a sequence complementary to the PBD on the 5' end of T. The unblocked primer nucleic acid molecule can bind to a template molecule at the PBD and copy the template molecule via polymerization by a polymerase.

Figure 3A:
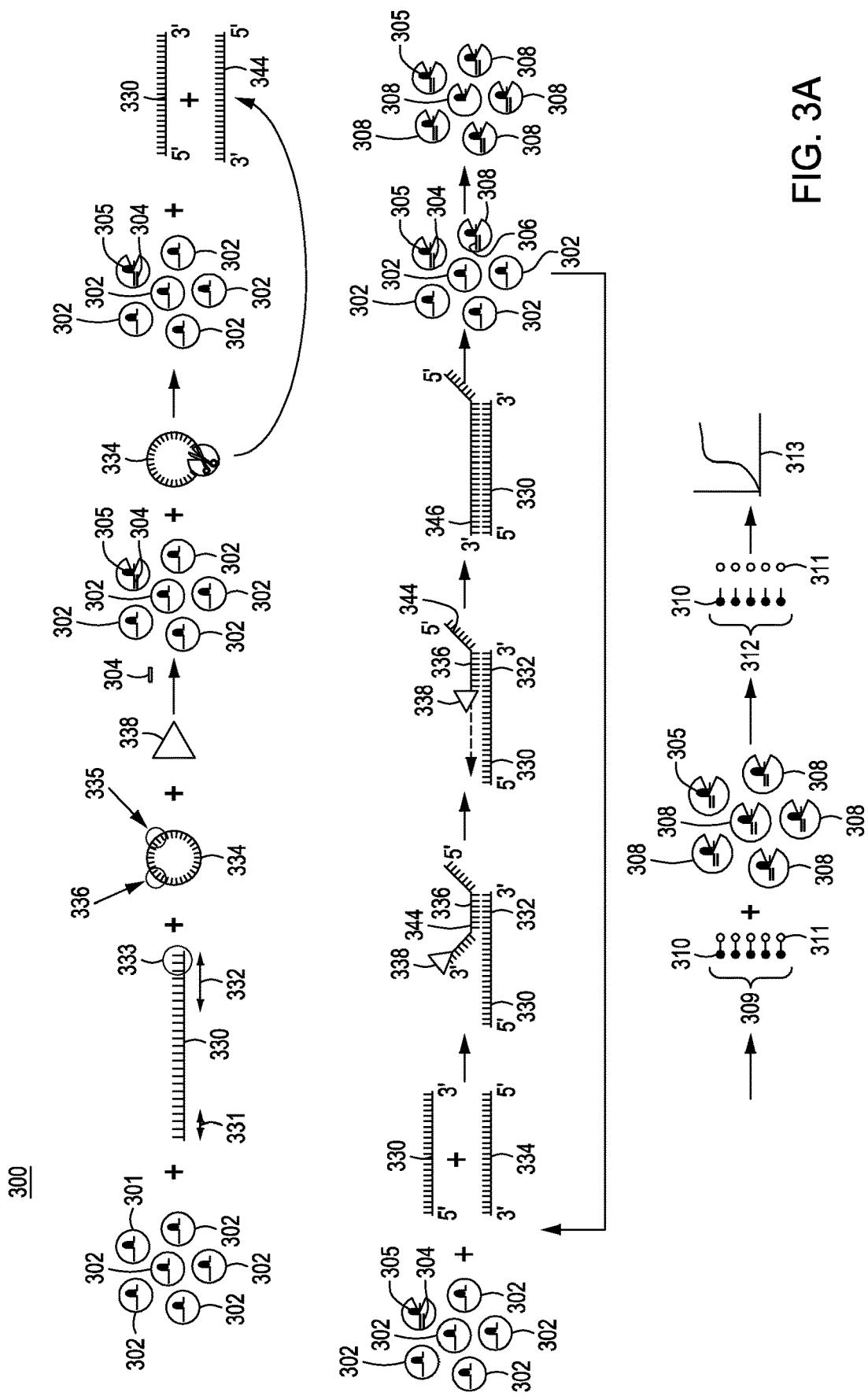
FIG. 3A is a diagram showing the sequence of steps in an exemplary cascade assay involving circular blocked primer molecules and linear template molecules.
Figure 3B:
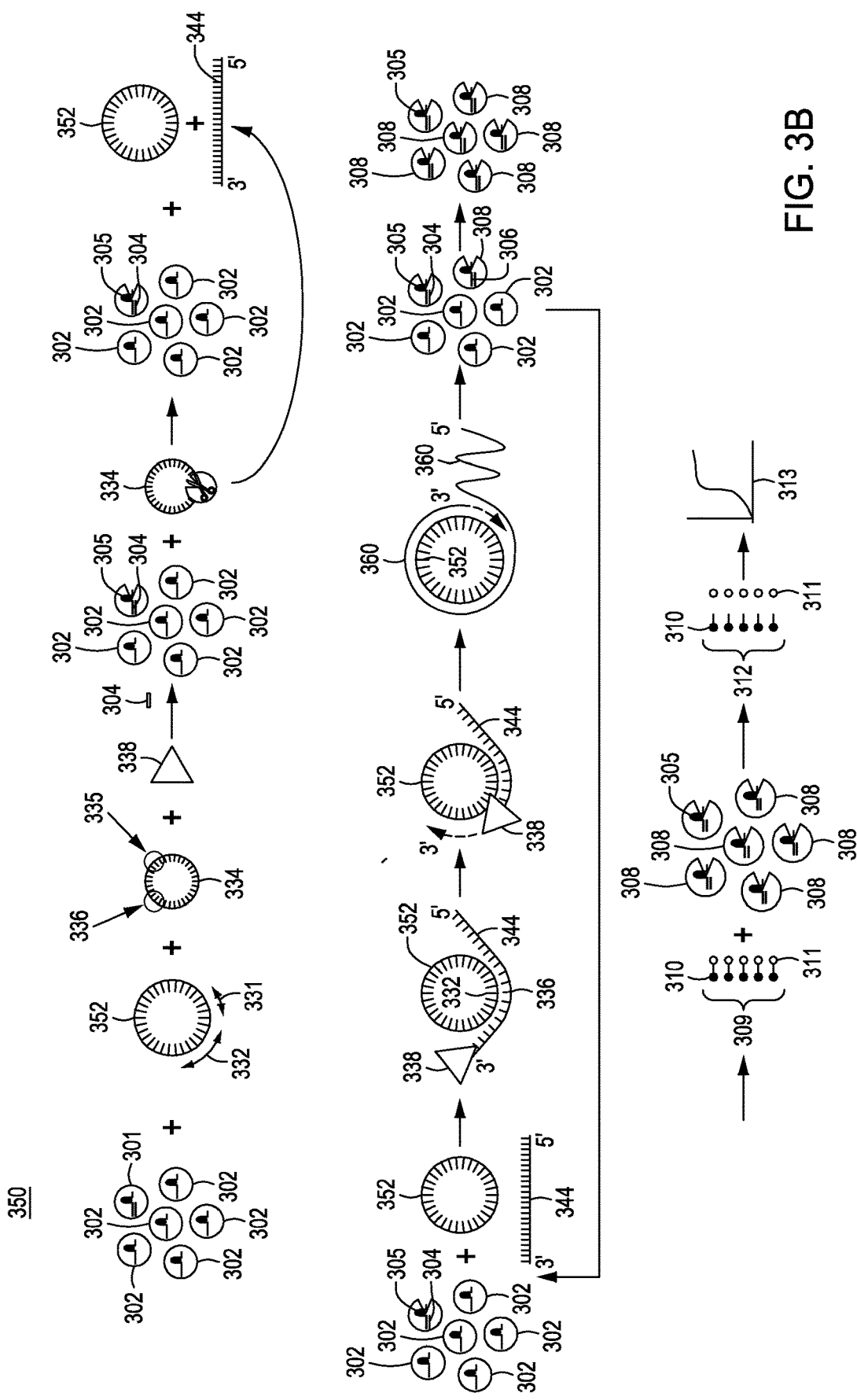
FIG. 3B is a diagram showing the sequence of steps in an exemplary cascade assay involving circular blocked primer molecules and circular template molecules.

Specific embodiments of the cascade assay which utilize blocked primer molecules and are depicted in FIGS. 3A and 3B. In the embodiments using blocked nucleic acid molecules described above, activation of RNP1 by binding of N nucleotides of the target nucleic acid molecules or cis-cleavage of the target nucleic acid molecules initiates trans-cleavage of the blocked nucleic acid molecules which were used to activate RNP2—that is, the unblocked nucleic acid molecules are a target sequence for the gRNA in RNP2. In contrast, in the embodiments using blocked primers activation of RNP1 and trans-cleavage unblocks a blocked primer molecule that is then used to prime a template molecule for extension by a polymerase, thereby synthesizing synthesized activating molecules that are the target sequence for the gRNA in RNP2.

FIG. 3A is a diagram showing the sequence of steps in an exemplary cascade assay involving circular blocked primer molecules and linear template molecules. At left of FIG. 3A is a cascade assay reaction mix comprising 1) RNP1s (301) (only one RNP1 is shown); 2) RNP2s (302); 3) linear template molecules (330) (which is the non-target strand); 4) a circular blocked primer molecule (334) (i.e., a high $K_d$ molecule); and 5) a polymerase (338), such as a (D29 polymerase. The linear template molecule (330) (non-target strand) comprises a PAM sequence (331), a primer binding domain (PBD) (332) and, optionally, a nucleoside modification (333) to protect the linear template molecule (330) from 3'→5' exonuclease activity. Blocked primer molecule (334) comprises a cleavable region (335) and a complement to the PBD (332) on the linear template molecule (330).

Upon addition of a sample comprising a target nucleic acid of interest (304) (capable of complexing with the gRNA in RNP1 (301)), the target nucleic acid of interest (304) is bound by with and activates RNP1 (305) but does not interact with or activate RNP2 (302). Once activated, RNP1 cuts the target nucleic acid of interest (304) via sequence specific cis-cleavage, which activates non-specific trans-cleavage of other nucleic acids present in the reaction mix, including at least one of the blocked primer molecules (334). The circular blocked primer molecule (334) (i.e., a high $K_d$ molecule, where high $K_d$ relates to binding to RNP2) upon cleavage becomes an unblocked linear primer molecule (344) (a low $K_d$ molecule, where low $K_d$ relates to binding to RNP2), which has a region (336) complementary to the PBD (332) on the linear template molecule (330) and can bind to the linear template molecule (330).

Once the unblocked linear primer molecule (344) and the linear template molecule (330) are hybridized (i.e., hybridized at the PBD (332) of the linear template molecule (330) and the PBD complement (336) on the unblocked linear primer molecule (344)), 3'→5' exonuclease activity of the polymerase (338) removes the unhybridized single-stranded DNA at the end of the unblocked primer molecule (344) and the polymerase (338) can copy the linear template molecule (330) to produce a synthesized activating molecule (346)

which is a complement of the non-target strand, which is the target strand. The synthesized activating molecule (346) is capable of activating RNP2 (302→308). As described above, because the nucleic acid-guided nuclease in the RNP2 (308) complex exhibits (that is, possesses) both cis- and trans-cleavage activity, more blocked primer molecules (334) become unblocked primer molecules (344) triggering activation of more RNP2s (308) and more trans-cleavage activity in a cascade. As stated above in relation to blocked and unblocked nucleic acid molecules (both linear and circular), the unblocked primer molecule has a higher binding affinity for the gRNA in RNP2 than does the blocked primer molecule, although there may be some "leakiness" where some blocked primer molecules are able to interact with the gRNA in RNP2. However, an unblocked primer molecule has a substantially higher likelihood than a blocked primer molecule to hybridize with the gRNA of RNP2.

FIG. 3A at bottom depicts the concurrent activation of reporter moieties. Intact reporter moieties (309) comprise a quencher (310) and a fluorophore (311). As described above in relation to FIG. 1B, the reporter moieties are also subject to trans-cleavage by activated RNP1 (305) and RNP2 (308). The intact reporter moieties (309) become activated reporter moieties (312) when the quencher (310) is separated from the fluorophore (311), and the fluorophore emits a fluorescent signal (313). Signal strength increases rapidly as more blocked primer molecules (334) become unblocked primer molecules (344) generating synthesized activating molecules (346) and triggering activation of more RNP2 (308) complexes and more trans-cleavage activity of the reporter moieties (309). Again, here the reporter moieties are shown as separate molecules from the blocked nucleic acid molecules, but other configurations may be employed and are discussed in relation to FIG. 4. Also, as with the cascade assay embodiment utilizing blocked nucleic acid molecules that are not blocked primers, with the exception of the gRNA in RNP1, the cascade assay components stay the same no matter what target nucleic acid(s) of interest are being detected.

FIG. 3B is a diagram showing the sequence of steps in an exemplary cascade assay involving circular blocked primer molecules and circular template molecules. The cascade assay of FIG. 3B differs from that depicted in FIG. 3A by the configuration of the template molecule. Where the template molecule in FIG. 3A was linear, in FIG. 3B the template molecule is circular. At left of FIG. 3B is a cascade assay reaction mix comprising 1) RNP1s (301) (only one RNP1 is shown); 2) RNP2s (302); 3) a circular template molecule (352) (non-target strand); 4) a circular blocked primer molecule (334); and 5) a polymerase (338), such as a (D29 polymerase. The circular template molecule (352) (non-target strand) comprises a PAM sequence (331) and a primer binding domain (PBD) (332). Blocked primer molecule (334) comprises a cleavable region (335) and a complement to the PBD (332) on the circular template molecule (352).

Upon addition of a sample comprising a target nucleic acid of interest (304) (capable of complexing with the gRNA in RNP1 (301)), the target nucleic acid of interest (304) binds to and activates RNP1 (305) but does not interact with or activate RNP2 (302). Once activated, RNP1 cuts the target nucleic acid of interest (304) via sequence specific cis-cleavage, which activates non-specific trans-cleavage of other nucleic acids present in the reaction mix, including at least one of the blocked primer molecules (334). The circular blocked primer molecule (334), upon cleavage, becomes an unblocked linear primer molecule (344), which has a region (336) complementary to the PBD (332) on the circular template molecule (352) and can hybridize with the circular template molecule (352).

Once the unblocked linear primer molecule (344) and the circular template molecule (352) are hybridized (i.e., hybridized at the PBD (332) of the circular template molecule (352) and the PBD complement (336) on the unblocked linear primer molecule (344)), 3'→5' exonuclease activity of the polymerase (338) removes the unhybridized single-stranded DNA at the 3' end of the unblocked primer molecule (344). The polymerase (338) can now use the circular template molecule (352) (non-target strand) to produce concatenated activating nucleic acid molecules (360) (which are concatenated target strands), which will be cleaved by the trans-cleavage activity of activated RNP1. The cleaved regions of the concatenated synthesized activating molecules (360) (target strand) are capable of activating the RNP2 (302→308) complex.

As described above, because the nucleic acid-guided nuclease in RNP2 (308) comprises both cis- and trans-cleavage activity, more blocked primer molecules (334) become unblocked primer molecules (344) triggering activation of more RNP2s (308) and more trans-cleavage activity in a cascade. FIG. 3B at bottom depicts the concurrent activation of reporter moieties. Intact reporter moieties (309) comprise a quencher (310) and a fluorophore (311). As described above in relation to FIG. 1B, the reporter moieties are also subject to trans-cleavage by activated RNP1 (305) and RNP2 (308). The intact reporter moieties (309) become activated reporter moieties (312) when the quencher (310) is separated from the fluorophore (311), and the fluorescent signal (313) is unquenched and can be detected. Signal strength increases rapidly as more blocked primer molecules (334) become unblocked primer molecules (344) generating synthesized activating nucleic acid molecules and triggering activation of more RNP2s (308) and more trans-cleavage activity of the reporter moieties (309). Again, here the reporter moieties are shown as separate molecules from the blocked nucleic acid molecules, but other configurations may be employed and are discussed in relation to FIG. 4. Also note that as with the other embodiments of the cascade assay, in this embodiment, with the exception of the gRNA in RNP1, the cascade assay components stay the same no matter what target nucleic acid(s) of interest are being detected.

The polymerases used in the "blocked primer molecule" embodiments serve to polymerize a reverse complement strand of the template molecule (non-target strand) to generate a synthesized activating molecule (target strand) as described above. In some embodiments, the polymerase is a DNA polymerase, such as a BST, T4, or Terminator polymerase (New England BioLabs Inc., Ipswich MA., USA). In some embodiments, the polymerase is a Klenow fragment of a DNA polymerase. In some embodiments the polymerase is a DNA polymerase with 5'→3' DNA polymerase activity and 3'→5' exonuclease activity, such as a Type I, Type II, or Type III DNA polymerase. In some embodiments, the DNA polymerase, including the Phi29, T7, Q5®, Q5U®, Phusion®, OneTaq®, LongAmp®, Vent®, or Deep Vent® DNA polymerases (New England BioLabs Inc., Ipswich MA., USA), or any active portion or variant thereof. Also, a 3' to 5' exonuclease can be separately used if the polymerase lacks this activity.

FIG. 4 depicts three mechanisms in which a cascade assay reaction can release a signal from a reporter moiety. FIG. 4 at top shows the mechanism discussed in relation to FIGS. 2A, 3A and 3B. In this embodiment, a reporter moiety 409 is a separate molecule from the blocked nucleic acid molecules present in the reaction mix. Reporter moiety (409) comprises a quencher (410) and a fluorophore (411). An activated reporter moiety (412) emits a signal from the fluorophore (411) once it has been physically separated from the quencher (410).

Reporter Moiety Configurations

FIG. 4 at center shows a blocked nucleic acid molecule (403), which is also a reporter moiety. In addition to quencher (410) and fluorophore (411), a blocking moiety (407) can be seen (see also blocked nucleic acid molecules 203 in FIG. 2A). Blocked nucleic acid molecule/reporter moiety (403) comprises a quencher (410) and a fluorophore (411). In this embodiment of the cascade assay, when the blocked nucleic acid molecule (403) is unblocked due to trans-cleavage initiated by the target nucleic acid of interest binding to RNP1, the unblocked nucleic acid molecule (406) also becomes an activated reporter moiety with fluorophore (411) separated from quencher (410). Note both the blocking moiety (407) and the quencher (410) are removed. In this embodiment, reporter signal is directly generated as the blocked nucleic acid molecules become unblocked. Embodiments of this schema can be used to supply the bulky modifications to the blocked nucleic acid molecules described below.

FIG. 4 at the bottom shows that cis-cleavage of an unblocked nucleic acid molecule or a synthesized activating molecule at a PAM distal sequence by RNP2 generates a signal. Shown are activated RNP2 (408), unblocked nucleic acid molecule (461), quencher (410), and fluorophore (411) forming an activated RNP2 with the unblocked nucleic acid/reporter moiety intact (460). Cis-cleavage of the unblocked nucleic acid/reporter moiety (461) results in an activated RNP2 with the reporter moiety activated (462), comprising the activated RNP2 (408), the unblocked nucleic acid molecule with the reporter moiety activated (463), quencher (410) and fluorophore (411). Embodiments of this schema also can be used to supply the bulky modifications to the blocked nucleic acid molecules described below, and in fact a combination of the configurations of reporter moieties shown in FIG. 4 at center and at bottom may be used.

Preventing Undesired Blocked Nucleic Acid Molecule Unwinding

The present disclosure improves upon the signal cascade assay described in U.S. Ser. Nos. 17/861,207; 17/861,208; and 17/861,209 by addressing the problem with undesired "unwinding" of the blocked nucleic acid molecule. As described above in detail in relation to FIGS. 1B, 2A, 2B, 2G, 3A, 3B, and 4, the cascade assay is initiated when a target nucleic acid of interest binds to and activates a first pre-assembled ribonucleoprotein complex (RNP1). The gRNA of RNP1 (gRNA1), comprising a sequence complementary to the target nucleic acid of interest, guides RNP1 to the target nucleic acid of interest. Upon binding of the target nucleic acid of interest to RNP1, RNP1 becomes activated, and the target nucleic acid of interest is cleaved in a sequence specific manner (i.e., cis-cleavage) while also triggering non-sequence specific, indiscriminate trans-cleavage activity which unblocks the blocked nucleic acid molecules in the reaction mix. The unblocked nucleic acid molecules can then activate a second pre-assembled ribonucleoprotein complex (RNP2), where RNP2 comprises a second gRNA (gRNA2) comprising a sequence complementary to the unblocked nucleic acid molecules, and at least one of the unblocked nucleic acid molecules is cis-cleaved in a sequence specific manner. Binding of the unblocked nucleic acid molecule to RNP2 leads to cis-cleavage of the unblocked nucleic acid molecule and non-sequence specific, indiscriminate trans-cleavage activity by RNP2, which in turn unblocks more blocked nucleic acid molecules (and reporter moieties) in the reaction mix activating more RNP2s. Each newly activated RNP2 activates more RNP2s, which in turn cleave more blocked nucleic acid molecules and reporter moieties in a reaction cascade, where all or most of the signal generated comes from the trans-cleavage activity of RNP2.

The improvement to the signal boost cascade assay described herein is drawn to preventing undesired unwinding of the blocked nucleic acid molecules in the reaction mix before the blocked nucleic acid molecules are unblocked via trans-cleavage; that is, preventing undesired unwinding that happens not as a result of unblocking due to trans-cleavage subsequent to cis-cleavage of the target nucleic acid of interest or trans-cleavage of unblocked nucleic acid molecules, but due to other factors. For a description of undesired unwinding, please see FIG. 1C and the attendant description herein. Minimizing undesired unwinding serves two purposes. First, preventing undesired unwinding that happens not as a result of designed or engineered unblocking leads to a "leaky" cascade assay system, which in turn leads to non-specific signal generation and false positives.

Second, preventing undesired unwinding limits non-specific interactions between the nucleic acid-guided nucleases (here, the RNP2s) and blocked nucleic acid molecules (i.e., the target nucleic acids for RNP2) such that only blocked nucleic acid molecules that become unblocked due to trans-cleavage activity react with the nucleic acid-guided nucleases. This "fidelity" in the cascade assay leads primarily to desired interactions and limits "wasteful" interactions where the nucleic acid-guided nucleases are essentially interacting with blocked nucleic acid molecules rather than interacting with unblocked nucleic acid molecules. That is, if unwinding is minimized the nucleic acid-guided nucleases are focused on desired interactions which then leads to immediate signal generation in the cascade assay. Preventing undesired unwinding leads to a more efficient cascade assay system providing more accurate quantification yet with the rapid results characteristic of the cascade assay (see FIGS. 10A-10H and 12 below).

Ratio of RNP2 to Blocked Nucleic Acid Molecules or Blocked Primers

In one modality to prevent undesired unwinding, the present disclosure describes using an unconventional ratio of blocked nucleic acid molecule (i.e., the target molecule for RNP2) and an RNP complex, here RNP2. The unconventional ratio may be used along with the blocked nucleic acid molecules and RNP2s described above as a primary method for minimizing unwinding or may be used in combination with the other modalities described below to minimize unwinding even more. For example, if one were to design an ideal blocked nucleic acid molecule having an "infinite $K_d$" such as, e.g., through design of the blocked nucleic acid molecule (or blocked primer molecule) and/or inclusion of bulky modifications on the blocked nucleic acid molecule (or blocked primer molecule), the ratio of blocked nucleic acid molecules to RNP2s would not affect the reaction mix to any discernable degree. The common wisdom of the ratio of enzyme to target (here, RNP2 to blocked nucleic acid molecule) is that results are achieved—a signal is generated—when there is a high concentration of nucleic acid-guided nuclease (i.e., RNP complex) and a lower concentration of target or, stated another way, when there is a significant excess of nucleic acid-guided nuclease to target.

As described above, in CRISPR detection/diagnostic assay protocols known to date, the CRISPR enzyme (i.e., nucleic acid-guided nuclease) is far in excess of blocked nucleic acid molecules (see, Sun, et al., J. of Translational Medicine, 12:74 (2021); Broughton, et al., Nat. Biotech., 38:870-74 (2020); and Lee, et al., PNAS, 117(41):25722-31 (2020)). However, in a cascade assay system where the nucleic acid-guided nuclease (or RNP complex) is in excess of the targets (here, the blocked nucleic acid molecules), the nucleic acid-guided nucleases encounter the blocked nucleic acid molecules repeatedly, probing the blocked nucleic acid molecules and subjecting them to unwinding. If the blocked nucleic acid molecules are probed and unwound repeatedly, they finally unwind which then triggers activation of RNP2 and cis-cleavage of the blocked nucleic acid molecule even in the absence of a target nucleic acid of interest and the trans-cleavage activity generated thereby.

However, by adjusting the ratio of RNP2 to blocked nucleic acid molecules such that there is an excess of blocked nucleic acid molecules to RNP2, any one blocked nucleic acid molecule may be probed by RNP2; however, the likelihood that any one blocked nucleic acid molecule will be probed repeatedly (and thus unwound) is much lower. If a blocked nucleic acid molecule is probed but then has time to re-hybridize or "recover", that blocked nucleic acid molecule will stay blocked, will not be subject to non-specific unwinding, and will not trigger activation of RNP2. That is, how often any one blocked nucleic acid molecule is probed is important. As long as an improperly probed blocked nucleic acid has time to re-hybridize after unwinding, there is far less chance that the blocked nucleic acid will be unblocked (i.e., unwound) and will trigger signal generation. That is, preventing non-specific unwinding of the blocked nucleic acid molecules makes the nucleic acid-guided nuclease available for desired unwinding interactions.

In order to prevent non-specific unwinding as described herein, the ratio of blocked nucleic acid molecules to RNP2 should be about 50:1, or about 40:1, or about 35:1, or about 30:1, or about 25:1, or about 20:1, or about 15:1, or about 10:1, or about 7.5:1, or about 5:1, or about 4:1, or about 3:1, or about 2.5:1, or about 2:1, or about 1.5:1, or at least where the molar concentration of blocked nucleic acid molecules is equal to or greater than the molar concentration of RNP2s. As noted above, the signal amplification cascade assay reaction mixture typically contains about 1 fM to about 1 mM of a given RNP2, or about 1 pM to about 500 µM of a given RNP2, or about 10 pM to about 100 µM of a given RNP2; thus, the signal amplification cascade assay reaction mixture typically contains about 2.5 fM to about 2.5 mM blocked nucleic acid molecules, or about 2.5 pM to about 1.25 mM blocked nucleic acid molecules, or about 25 pM to about 250 µM blocked nucleic acid molecules. That is, the reaction mixture contains about $6\times10^4$ to about $6\times10^{14}$ RNP2s per microliter (µl) or about $6\times10^6$ to about $6\times10^{12}$ RNP2s per microliter (µl) and thus about $6\times10^4$ to about $6\times10^{14}$ RNP2s per microliter (µl) or about $6\times10^6$ to about $6\times10^{12}$ blocked nucleic acid molecules per microliter (µl). Note, the ratios may be used along with the blocked nucleic acid molecules and RNP2s described above as a primary method for minimizing unwinding or the ratios of blocked nucleic acid molecules to RNP2s may be used in combination with the other modalities described below to further minimize unwinding. Again, if one were to design an ideal blocked nucleic acid molecule having an "infinite $K_d$", the ratio of blocked nucleic acid molecules to RNP2s would not affect the reaction mix to any discernable degree and the ratios of blocked nucleic acid molecules to RNP2s would not necessarily be within these ranges.

Variant Engineered Nucleic Acid-Guided Nucleases

In some embodiments, the protein sequence of the Cas12a nucleic acid-guided nuclease is modified, with e.g., mutations to the domains that interact with the PAM region or surrounding sequences on the blocked nucleic acid molecules (see Shin et al., Front. Genet., 11:1577 (2021); doi: 10.3389/fgene.2020.571591, herein incorporated by reference; and Yamano et al., Mol. Cell, 67(4): 633-645 (2017); doi: 10.1016/j.molcel.2017.06.035, herein incorporated by reference) such that the variant engineered nucleic acid-guided nuclease has reduced (or absent) PAM specificity, relative to the unmodified or wildtype nucleic acid-guided nuclease and reduced cleavage activity in relation to double strand DNA with or without a PAM. Such enzymes are referred to herein as single-strand-specific Cas12a nucleic acid-guided nucleases or variant engineered nucleic acid-guided nucleases.

Figure 5:
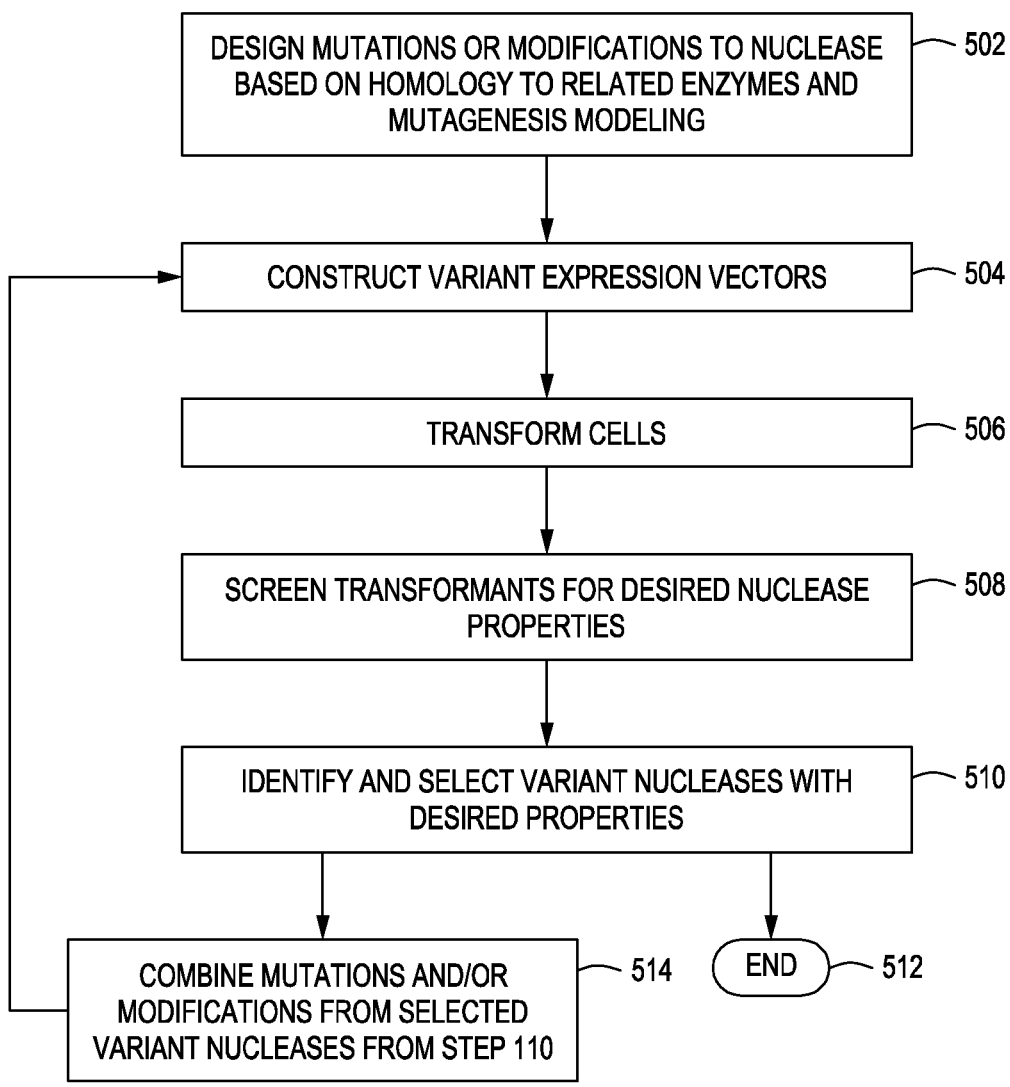
FIG. 5 is a simplified block diagram of an exemplary method for designing, synthesizing and screening variant nucleic acid-guided nucleases.

FIG. 5 is a simplified block diagram of an exemplary method 500 for designing, synthesizing and screening variant nucleic acid-guided nucleases. In a first step, mutations or modifications to a nucleic acid-guided nuclease are designed 502, based on, e.g., homology to related nucleic acid-guided nucleases, predicted protein structure and active site configuration, and mutagenesis modeling. For assessment of homologies to other nucleic acid-guided nucleases, amino acid sequences may be found in publicly available databases known to those with skill in the art, including, e.g., Protein DataBank Europe (PDBe), Protein Databank Japan (PDBj), SWISS-PROT, GenBank, RefSeq, TrEMBL, PROSITE, DisProt, InterPro, PIR-International, and PRF/SEQDB. Amino acid homology alignments for purposes of determining similarities to known nucleic acid-guided nucleases can be performed using CUSTALW, CUSTAL OMEGA, COBALT: Multiple Alignment Tool; SIM; and PROBCONS.

For protein engineering and amino acid substitution model predictions for each of the desired mutations, protein modeling software such as SWISS-MODEL, HHpred, I-TASSER, IntFOLD, RaptorX, FoldX, Rosetta, and trRosetta may be used to simulate the structural change(s) and to calculate various parameters due to the structural changes as a result of the amino acid substitution(s), including root mean square deviation (RMSD) value in Angstrom units (i.e., a measurement of the difference between the backbones of the initial nucleic acid-guided nuclease and the mutated nucleic acid nucleic acid-guided nuclease) and changes to the number of hydrogen bonds and conformation in the active site. For the methods used to generate the variant engineered nucleic acid-guided nucleases described herein, see Example VII below.

Following modelling, coding sequences for the variant nucleic acid-guided nucleases that appear to deliver desired properties are synthesized and inserted into an expression vector 504. Methods for site-directed mutagenesis are known in the art, including PCR-based methods such as traditional PCR, where primers are designed to include the desired change; primer extension, involving incorporating mutagenic primers in independent nested PCR before combining them in the final product; and inverse PCR. Additionally, CRISPR gene editing may be performed to introduce the desired mutation or modification to the nucleic acid-guided nuclease coding sequence. The mutated (variant) coding sequences are inserted into an expression vector backbone comprising regulatory sequences such as enhancer and promoter regions. The type of expression vector (e.g., plasmid or viral vector) will vary depending on the type of cells to be transformed.

At step 506, cells of choice are transformed with the variant expression vectors. A variety of delivery systems may be used to introduce (e.g., transform or transfect) the expression vectors into a host cell, including the use of yeast systems, lipofection systems, microinjection systems, biolistic systems, virosomes, liposomes, immunoliposomes, polycations, lipid:nucleic acid conjugates, virions, artificial virions, viral vectors, electroporation, cell permeable peptides, nanoparticles, nanowires, exosomes. Once cells are transformed (or transfected), the transformants are allowed to recover and grow.

Following transformation, the cells are screened for expression of nucleic acid-guided nucleases with desired properties 508, such as cut activity or lack thereof, paste activity or lack thereof, PAM recognition or changes thereto, stability and the ability to form RNPs at various temperatures, and/or cis- and trans-cleavage activity at various temperatures. The assays used to screen the variant nucleic acid-guided nucleases will vary depending on the desired properties, but may include in vitro and in vivo PAM depletion, assays for editing efficiency such as a GFP to BFP assay, and, as used to assess the variant nucleic acid-guided nucleases described herein, in vitro transcription/translation (IVTT) assays were used to measure in vitro trans cleavage with both dsDNA and ssDNA and with and without the presence of a PAM in the blocked nucleic acid molecules, where dsDNA should not activate trans-cleavage regardless of the presence of PAM sequence.

After screening the variant nucleic acid-guided nucleases via the IVTT assays, variants with the preferred properties are identified and selected 510. At this point, a variant may be chosen 512 to go forward into production for use in, e.g., the CRISPR cascade systems described herein; alternatively, promising mutations and/or modifications may be combined 514 and the construction, screening and identifying process is repeated.

In some embodiments, the single-strand-specific Cas12a nucleic acid-guided nuclease may not recognize one or more of the following PAM or partial PAM sequences (listed from 5' to 3'): TTTN, TTTV, CTTA, CTTV, TCTV, TTCV, YTV, or YTN wherein "A" represents adenine, "C" represents cytosine, "T" represents thymine, "G" represents guanine, "V" represents guanine or cytosine or adenine, "Y" represents guanine or adenine, and "N" represents any nucleotide. In some embodiments, the Cas12a nucleic acid-guided nuclease may have reduced recognition for one or more of the following PAM or partial PAM sequences (listed from 5' to 3'): TTTN, TTTV, CTTA, CTTV, TCTV, TTCV, YTV, or YTN. The single-strand-specific Cas12a nucleic acid-guided nucleases described herein may have at least 50% (e.g., at least 50%, at least 60%, at least 70%, at least 80%, at least 90%, at least 95%, or 100%, such as about 50%, about 55%, about 60%, about 65%, about 70%, about 75%, about 80%, about 85%, about 90%, about 95%, or about 100%) reduced recognition (i.e., specificity) for one or more of the following PAM or partial PAM sequences (listed from 5' to 3'): TTTN, TTTV, CTTA, CTTV, TCTV, TTCV, YTV, or YTN.

Figure 6A:
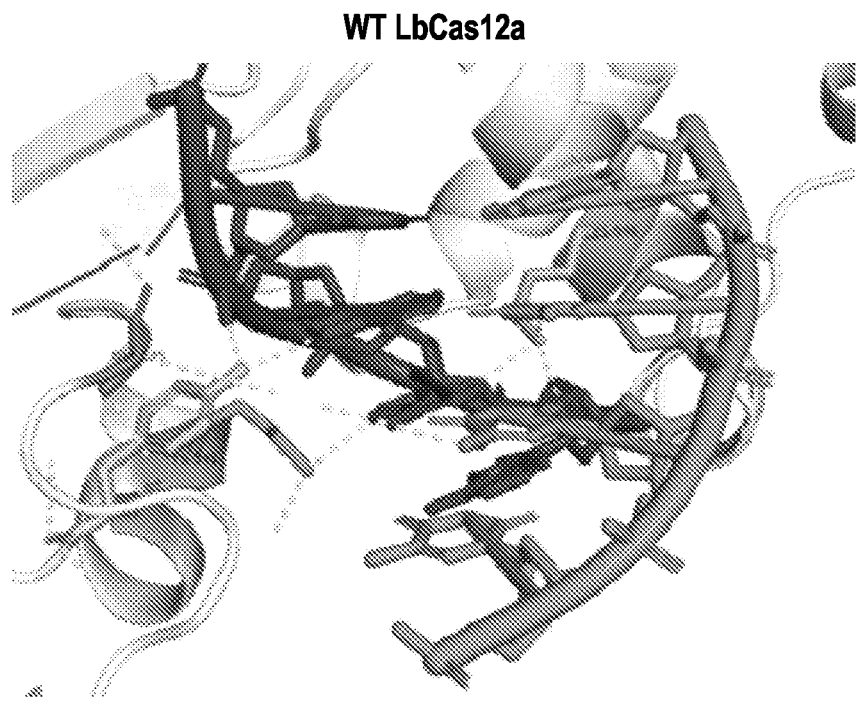
FIG. 6A shows the result of protein structure prediction using Rosetta and SWISS modeling of wildtype LbCas12a (Lachnospiraceae bacterium Cas12a).
Figure 6B:
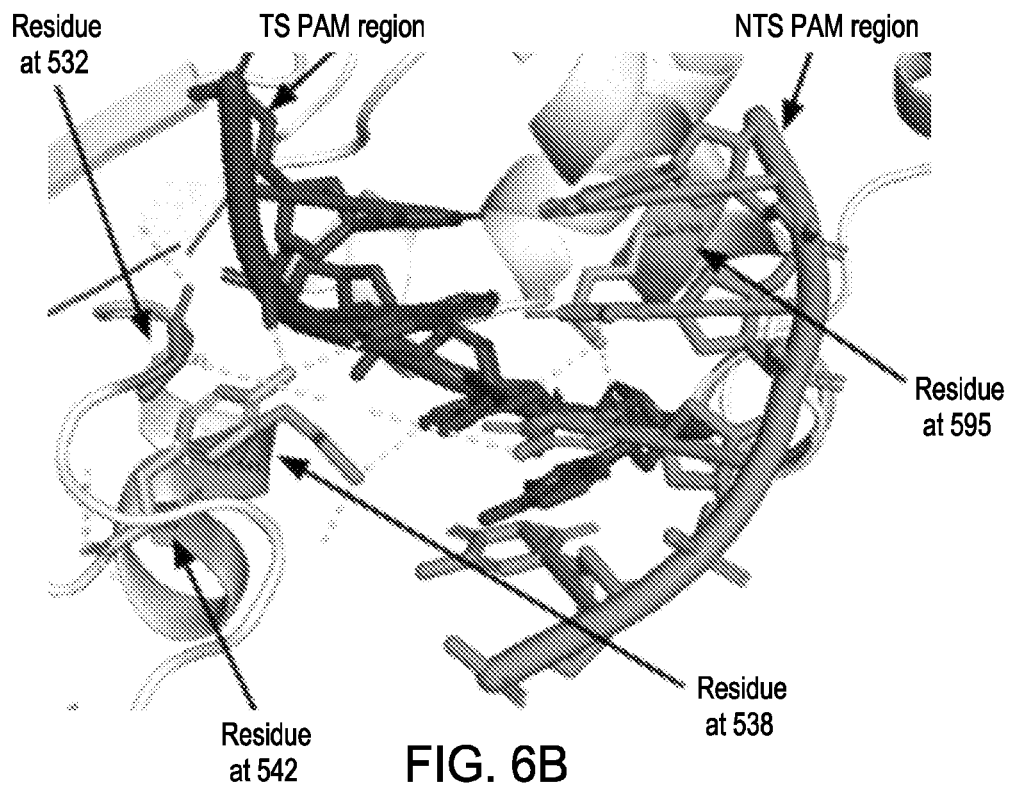
FIG. 6B shows the result of example mutations on the LbCas12a protein structure prediction using Rosetta and SWISS modeling of LbCas12a and indicating the PAM regions.

Exemplary wild type (WT) Cas12a protein sequences are described in Table 7 below. FIG. 6A shows the result of protein structure prediction using Rosetta and SWISS modeling of wildtype LbCas 12a (Lachnospriaceae bacterium Cas 12a), and FIG. 6B shows the result of example mutations on the LbCas 12a protein structure prediction using Rosetta and SWISS modeling of LbCas12a and indicating the PAM regions (described in more detail in relation to Example VII). Any of these sequences (e.g., SEQ ID NOs: 1-15 and homologs or orthologs thereof) may be modified, as described herein, to generate a single-strand-specific nucleic acid-guided nuclease.

TABLE 7

Exemplary wild type Cas12a nucleic acid-guided nucleases

| Species Name Reference ID | SEQ ID NO: | Protein Sequence |
|---|---|---|
| Lachnospiraceae bacterium Cas12a (LbCas12a) PDD: 6KL9_A | SEQ ID NO: 1 | MSKLEKFTNCYSLSKTLRFKAIPVGKTQENIDNKRLLVEDEKRAED YKGVVKKLLDRYYLSFINDVLHSIKLKNLNNYISLFRKKTRTEKENK ELENLEINLRKEIAKAFKGNEGYKSLFKKDIIETILPEFLDDKDEIAL VNSFNGFTTAFTGFFDNRENMFSEEAKSTSIAFRCINENLTRYISNM DIPEKVDAIFDKHEVQEIKEKILNSDYDVEDFFEGEFFNPVLTQEGI DVYNAIIGGFVTESGEKIKGLNEYINLYNQKTKQKLPKFKPLYKQV LSDRESLSFYGEGYTSDEEVLEVFRNTLNKNSEIFSSIKKLEKLFKN FDEYSSAGIFVKNGPAISTISKDIFGEWNVIRDKWNAEYDDIHLKK KAVVTEKYEDDRRKSFKKIGSFSLEQLQEYADADLSVVEKLKEIIIQ KVDEIYKVYGSSEKLFDADFVLEKSLKKNDAVVAIMKDLLDSVKS FENYIKAFFGEGKETNRDESFYGDFVLAYDILLKVDHIYDAIRNYV TQKPYSKDKFKLYFQNPQFMGGWDKDKETDYRATILRYGSKYYL AIMDKKYAKCLQKIDKDDVNGNYEKINYKLLPGPNKMLPKVFFSK KWMAYYNPSEDIQKIYKNGTFKKGDMFNLNDCHKLIDFFKDSISR YPKWSNAYDFNFSETEKYKDIAGFYREVEEQGYKVSFESASKKEV DKLVEEGKLYMFQIYNKDFSDKSHGTPNLHTMYFKLLFDENNHG QIRLSGGAELFMRRASLKKEELVVHPANSPIANKNPDNPKKTTTLS YDVYKDKRFSEDQYELHIPIAINKCPKNIFKINTEVRVLLKHDDNPY VIGIDRGERNLLYIVVVDGKGNIVEQYSLNEIINNFNGIRIKTDYHSL LDKKEKERFEARQNWTSIENIKELKAGYISQVVHKICELVEKYDAV IALEDLNSGFKNSRVKVEKQVYQKFEKMLIDKLNYMVDKKSNPC ATGGALKGYQITNKFESFKSMSTQNGFIFYIPAWLTSKIDPSTGFVN LLKTKYTSIADSKKFISSFDRIMYVPEEDLFEFALDYKNFSRTDADY IKKWKLYSYGNRIRIFRNPKKNNVFDWEEVCLTSAYKELFNKYGI NYQQGDIRALLCEQSDKAFYSSFMALMSLMLQMRNSITGRTDVDF LISPVKNSDGIFYDSRNYEAQENAILPKNADANGAYNIARKVLWAI GQFKKAEDEKLDKVKIAISNKEWLEYAQTSVKH |

TABLE 7-continued

Exemplary wild type Cas12a nucleic acid-guided nucleases

| Species Name Reference ID | SEQ ID NO: | Protein Sequence |
|---|---|---|
| Acidaminococcus sp. Cas12a (AsCas12a) NCBI Ref.: WP_021736722.1 | SEQ ID NO: 2 | MTQFEGFTNLYQVSKTLRFELIPQGKTLKHIQEQGFIEEDKARNDH YKELKPIIDRIYKTYADQCLQLVQLDWENLSAAIDSYRKEKTEETR NALIEEQATYRNAIHDYFIGRTDNLTDAINKRHAEIYKGLFKAELFN GKVLKQLGTVTTTEHENALLRSFDKFTTYFSGFYENRKNVFSAEDI STAIPHRIVQDNFPKFKENCHIFTRLITAVPSLREHFENVKKAIGIFV STSIEEVFSFPFYNQLLTQTQIDLYNQLLGGISREAGTEKIKGLNEVL NLAIQKNDETAHIIASLPHRFIPLFKQILSDRNTLSFILEEFKSDEEVI QSFCKYKTLLRNENVLETAEALFNELNSIDLTHIFISHKKLETISSAL CDHWDTLRNALYERRISELTGKITKSAKEKVQRSLKHEDINLQEIIS AAGKELSEAFKQKTSEILSHAHAALDQPLPTTLKKQEEKEILKSQL DSLLGLYHLLDWFAVDESNEVDPEFSARLTGIKLEMEPSLSFYNKA RNYATKKPYSVEKFKLNFQMPTLASGWDVNKEKNNGAILFVKNG LYYLGIMPKQKGRYKALSFEPTEKTSEGFDKMYYDYFPDAAKMIP KCSTQLKAVTAHFQTHTTPILLSNNFIEPLEITKEIYDLNNPEKEPKK FQTAYAKKTGDQKGYREALCKWIDFTRDFLSKYTKTTSIDLSSLRP SSQYKDLGEYYAELNPLLYHISFQRIAEKEIMDAVETGKLYLFQIY NKDFAKGHHGKPNLHTLYWTGLFSPENLAKTSIKLNGQAELFYRP KSRMKRMAHRLGEKMLNKKLKDQKTPIPDTLYQELYDYVNHRLS HDLSDEARALLPNVITKEVSHEIIKDRRFTSDKFFFHVPITLNYQAA NSPSKFNQRVNAYLKEHPETPIIGIDRGERNLIYITVIDSTGKILEQRS LNTIQQFDYQKKLDNREKERVAARQAWSVVGTIKDLKQGYLSQVI HEIVDLMIHYQAVVVLENLNFGFKSKRTGIAEKAVYQQFEKMLID KLNCLVLKDYPAEKVGGVLNPYQLTDQFTSFAKMGTQSGFLFYVP APYTSKIDPLTGFVDPFVWKTIKNHESRKHFLEGFDFLHYDVKTGD FILHFKMNRNLSFQRGLPGFMPAWDIVFEKNETQFDAKGTPFIAGK RIVPVIENHRFTGRYRDLYPANELIALLEEKGIVFRDGSNILPKLLEN DDSHAIDTMVALIRSVLQMRNSNAATGEDYINSPVRDLNGVCFDS RFQNPEWPMDADANGAYHIALKGQLLLNHLKESKDLKLQNGISN QDWLAYIQELRN |
| Candidatus Methanoplasma termitum (CtCas12a) NCBI Gene ID: 24818655 | SEQ ID NO: 3 | MNNYDEFTKLYPIQKTIRFELKPQGRTMEHLETFNFFEEDRDRAEK YKILKEAIDEYHKKFIDEHLTNMSLDWNSLKQISEKYYKSREEKDK KVFLSEQKRMRQEIVSEFKKDDRFKDLFSKKLFSELLKEEIYKKGN HQEIDALKSFDKFSGYFIGLHENRKNMYSDGDEITAISNRIVNENFP KFLDNLQKYQEARKKYPEWIIKAESALVAHNIKMDEVFSLEYFNK VLNQEGIQRYNLALGGYVTKSGEKMMGLNDALNLAHQSEKSSKG RIHMTPLFKQILSEKESFSYIPDVFTEDSQLLPSIGGFFAQIENDKDG NIFDRALELISSYAEYDTERIYIRQADINRVSNVIFGEWGTLGGLMR EYKADSINDINLERTCKKVDKWLDSKEFALSDVLEAIKRTGNNDA FNEYISKMRTAREKIDAARKEMKFISEKISGDEESIHIIKTLLDSVQQ FLHFFNLFKARQDIPLDGAFYAEFDEVHSKLFAIVPLYNKVRNYLT KNNLNTKKIKLNFKNPTLANGWDQNKVYDYASLIFLRDGNYYLGI INPKRKKNIKFEQGSGNGPFYRKMVYKQIPGPNKNLPRVFLTSTKG KKEYKPSKEIIEGYEADKHIRGDKFDLDFCHKLIDFFKESIEKHKDW SKFNFYFSPTESYGDISEFYLDVEKQGYRMHFENISAETIDEYVEKG DLFLFQIYNKDFVKAATGKKDMHTIYWNAAFSPENLQDVVVKLN GEAELFYRDKSDIKEIVHREGEILVNRTYNGRTPVPDKIHKKLTDY HNGRTKDLGEAKEYLDKVRYFKAHYDITKDRRYLNDKIYFHVPLT LNFKANGKKNLNKMVIEKFLSDEKAHIIGIDRGERNLLYYSIIDRSG KIIDQQSLNVIDGFDYREKLNQREIEMKDARQSWNAIGKIKDLKEG YLSKAVHEITKMAIQYNAIVVMEELNYGFKRGRFKVEKQIYQKFE NMLIDKMNYLVFKDAPDESPGGVLNAYQLTNPLESFAKLGKQTGI LFYVPAAYTSKIDPTTGFVNLFNTSSKTNAQERKEFLQKFESISYSA KDGGIFAFAFDYRKFGTSKTDHKNVWTAYTNGERMRYIKEKKRN ELFDPSKEIKEALTSSGIKYDGGQNILPDILRSNNNGLIYTMYSSFIA AIQMRVYDGKEDYIISPIKNSKGEFFRTDPKRRELPIDADANGAYNI ALRGELTMRAIAEKFDPDSEKMAKLELKHKDWFEFMQTRGD |
| Eubacterium eligens (EeCas12a) NCBI Gene ID: 41356122 | SEQ ID NO: 4 | MNGNRSIVYREFVGVIPVAKTLRNELRPVGHTQEHIIQNGLIQEDEL RQEKSTELKNIMDDYYREYIDKSLSGVTDLDFTLLFELMNLVQSSP SKDNKKALEKEQSKMREQICTHLQSDSNYKNIFNAKLLKEILPDFI KNYNQYDVKDKAGKLETLALFNGFSTYFTDFFEKRKNVFTKEAVS TSIAYRIVHENSLIFLANMTSYKKISEKALDEIEVIEKNNQDKMGD WELNQIFNPDFYNMVLIQSGIDFYNEICGVVNAHMNLYCQQTKNN YNLFKMRKLHKQILAYTSTSFEVPKMFEDDMSVYNAVNAFIDETE KGNIIGKLKDIVNKYDELDEKRIYISKDFYETLSCFMSGNWNLITGC VENFYDENIHAKGKSKEEKVKKAVKEDKYKSINDVNDLVEKYIDE KERNEFKNSNAKQYIREISNIITDTETAHLEYDDHISLIESEEKADEM KKRLDMYMNMYHWAKAFIVDEVLDRDEMFYSDIDDIYNILENIVP LYNRVRNYVTQKPYNSKKIKLNFQSPTLANGWSQSKEFDNNAIILI RDNKYYLAIFNAKNKPDKKIIQGNSDKKNDNDYKKMVYNLLPGA NKMLPKVFLSKKGIETFKPSDYIISGYNAHKHIKTSENFDISFCRDLI DYFKNSIEKHAEWRKYEFKFSATDYSDISEFYREVEMQGYRIDW TYISEADINKLDEEGKIYLFQIYNKDFAENSTGKENLHTMYFKNIFS |

TABLE 7-continued

Exemplary wild type Cas12a nucleic acid-guided nucleases

| Species Name Reference ID | SEQ ID NO: | Protein Sequence |
|---|---|---|
| | | EENLKDIIIKLNGQAELFYRRASVKNPVKHKKDSVLVNKTYKNQL DNGDVVRIPIPDDIYNEIYKMYNGYIKESDLSEAAKEYLDKVEVRT AQKDIVKDYRYTVDKYFIHTPITINYKVTARNNVNDMVVKYIAQN DDIHVIGIDRGERNLIYSVIDSHGNIVKQKSYNILNNYDYKKKLVE KEKTREYARKNWKSIGNIKELKEGYISGVVHEIAMLIVEYNAIIAM EDLNYGFKRGRFKVERQVYQKFESMLINKLNYFASKEKSVDEPGG LLKGYQLTYVPDNIKNLGKQCGVIFYVPAAFTSKIDPSTGFISAFNF KSISTNASRKQFFMQFDEIRYCAEKDMFSFGFDYNNFDTYNITMGK TQWTVYTNGERLQSEFNNARRTGKTKSINLTETIKLLLEDNEINYA DGHDIRIDMEKMDEDKKSEFFAQLLSLYKLTVQMRNSYTEAEEQE NGISYDKIISPVINDEGEFFDSDNYKESDDKECKMPKDADANGAYC IALKGLYEVLKIKSEWTEDGFDRNCLKLPHAEWLDFIQNKRYE |
| Moraxella bovoculi Cas12a (Mb3Cas12a) GenBank: AKG12737.1 | SEQ ID NO: 5 | MLFQDFTHLYPLSKTVRFELKPIGKTLEHIHAKNFLNQDETMADM YQKVKAILDDYHRDFIADMMGEVKLTKLAEFYDVYLKFRKNPKD DGLQKQLKDLQAVLRKEIVKPIGNGGKYKAGYDRLFGAKLFKDG KELGDLAKFVIAQEGESSPKLAHLAHFEKFSTYFTGFHDNRKNMY SDEDKHTAIAYRLIHENLPRFIDNLQILATIKQKHSALYDQIINELTA SGLDVSLASHLDGYHKLLTQEGITAYNTLLGGISGEAGSRKIQGINE LINSHHNQHCHKSERIAKLRPLHKQILSDGMGVSFLPSKFADDSEV CQAVNEFYRHYADVFAKVQSLFDGFDDYQKDGIYVEYKNLNELS KQAFGDFALLGRVLDGYYVDVVNPEFNERFAKAKTDNAKAKLTK EKDKFIKGVHSLASLEQAIEHYTARHDDESVQAGKLGQYFKHGLA GVDNPIQKIHNNHSTIKGFLERERPAGERALPKIKSDKSPEIRQLKEL LDNALNVAHFAKLLTTKTTLHNQDGNFYGEFGALYDELAKIATLY NKVRDYLSQKPFSTEKYKLNFGNPTLLNGWDLNKEKDNFGVILQK DGCYYLALLDKAHKKVFDNAPNTGKSVYQKMIYKLLPGPNKMLP KVFFAKSNLDYYNPSAELLDKYAQGTHKKGDNFNLKDCHALIDFF KAGINKHPEWQHFGFKFSPTSSYQDLSDFYREVEPQGYQVKFVDIN ADYINELVEQGQLYLFQIYNKDFSPKAHGKPNLHTLYFKALFSEDN LVNPIYKLNGEAEIFYRKASLDMNETTIHRAGEVLENKNPDNPKKR QFVYDIIKDKRYTQDKFMLHVPITMNFGVQGMTIKEFNKKVNQSI QQYDEVNVIGIDRGERHLLYLTVINSKGEILEQRSLNDITTASANGT QMTTPYHKILDKREIERLNARVGWGEIETIKELKSGYLSHVVHQIS QLMLKYNAIVVLEDLNFGFKRGRFKVEKQIYQNFENALIKKLNHL VLKDKADDEIGSYKNALQLTNNFTDLKSIGKQTGFLFYVPAWNTS KIDPETGFVDLLKPRYENIAQSQAFFGKFDKICYNADRGYFEFHIDY AKFNDKAKNSRQIWKICSHGDKRYVYDKTANQNKGATIGVNVND ELKSLFTRYHINDKQPNLVMDICQNNDKEFHKSLMYLLKTLLALR YSNASSDEDFILSPVANDEGVFFNSALADDTQPQNADANGAYHIA LKGLWLLNELKNSDDLNKVKLAIDNQTWLNFAQNR |
| Francisella novicida Cas12a (FnCas12a) UniProtKB/Swiss- Prot: A0Q7Q2.1 | SEQ ID NO: 6 | MSIYQEFVNKYSLSKTLRFELIPQGKTLENIKARGLILDDEKRAKDY KKAKQIIDKYHQFFIEEILSSVCISEDLLQNYSDVYFKLKKSDDDNL QKDFKSAKDTIKKQISEYIKDSEKFKNLFNQNLIDAKKGQESDLIL WLKQSKDNGIELFKANSDITDIDEALEIIKSFKGWTTYFKGFHENRK NVYSSNDIPTSIIYRIVDDNLPKFLENKAKYESLKDKAPEAINYEQIK KDLAEELTFDIDYKTSEVNQRVFSLDEVFEIANFNNYLNQSGITKFN TIIGGKFVNGENTKRKGINEYINLYSQQINDKTLKKYKMSVLFKQIL SDTESKSFVIDKLEDDSDVVTTMQSFYEQIAAFKTVEEKSIKETLSL LFDDLKAQKLDLSKIYFKNDKSLTDLSQQVFDDYSVIGTAVLEYIT QQIAPKNLDNPSKKEQELIAKKTEKAKYLSLETIKLALEEFNKHRDI DKQCRFEEILANFAAIPMIFDEIAQNKDNLAQISIKYQNQGKKDLLQ ASAEDDVKAIKDLLDQTNNLLHKLKIFHISQSEDKANILDKDEHFY LVFEECYFELANIVPLYNKIRNYITQKPYSDEKFKLNFENSTLANG WDKNKEPDNTAILFIKDDKYYLGVMNKKNNKIFDDKAIKENKGE GYKKIVYKLLPGANKMLPKVFFSAKSIKFYNPSEDILRIRNHSTHTK NGSPQKGYEKFEFNIEDCRKFIDFYKQSISKHPEWKDFGFRFSDTQR YNSIDEFYREVENQGYKLTFENISESYIDSVVNQGKLYLFQIYNKDF SAYSKGRPNLHTLYWKALFDERNLQDVVYKLNGEAELFYRKQSIP KKITHPAKEAIANKNKDNPKKESVFEYDLIKDKRFTEDKFFFHCPIT INFKSSGANKFNDEINLLLKEKANDVHILSIDRGERHLAYYTLVDG KGNIIKQDTFNIIGNDRMKTNYHDKLAAIEKDRDSARKDWKKINNI KEMKEGYLSQVVHEIAKLVIEYNAIVVFEDLNFGFKRGRFKVEKQ VYQKLEKMLIEKLNYLVFKDNEFDKTGGVLRAYQLTAPFETFKK MGKQTGIIYYVPAGFTSKICPVTGFVNQLYPKYESVSKSQEFFSKFD KICYNLDKGYFEFSFDYKNFGDKAAKGKWTIASFGSRLINFRNSDK NHNWDTREVYPTKELEKLLKDYSIEYGHGECIKAAICGESDKKFFA KLTSVLNTILQMRNSKTGTELDYLISPVADVNGNFFDSRQAPKNMP QDADANGAYHIGLKGLMLLGRIKNNQEGKKLNLVIKNEEYFEFVQ NRNN |

TABLE 7-continued

Exemplary wild type Cas12a nucleic acid-guided nucleases

| Species Name Reference ID | SEQ ID NO: | Protein Sequence |
|---|---|---|
| *Francisella tularensis* subsp. *novicida* FTG Cas12a (FnoCas12a) NCBI Gene ID: 60806594 | SEQ ID NO: 7 | MSIYQEFVNKYSLSKTLRFELIPQGKTLENIKARGLILDDEKRAKDY KKAKQIIDKYHQFFIEEILSSVCISEDLLQNYSDVYFKLKKSDDDNL QKDFKSAKDTIKKQISKYINDSEKFKNLFNQNLIDAKKGQESDLIL WLKQSKDNGIELFKANSDITDIDEALEIIKSFKGWTTYFKGFHENRK NVYSSNDIPTSIIYRIVDDNLPKFLENKAKYESLKDKAPEAINYEQIK KDLAEELTFDIDYKTSEVNQRVFSLDEVFEIANFNNYLNQSGITKFN TIIGGKFVNGENTKRKGINEYINLYSQQINDKTLKKYKMSVLFKQIL SDTESKSFVIDKLEDDSDVVTTMQSFYEQIAAFKTVEEKSIKETLSL LFDDLKAQKLDLSKIYFKNDKSLTDLSQQVFDDYSVIGTAVLEYIT QQVAPKNLDNPSKKEQDLIAKKTEKAKYLSLETIKLALEEFNKHRD IDKQCRFEEILSNFAAIPMIFDEIAQNKDNLAQISIKYQNQGKKDLL QASAEEDVKAIKDLLDQTNNLLHRLKIFHISQSEDKANILDKDEHF YLVFEECYFELANIVPLYNKIRNYITQKPYSDEKFKLNFENSTLASG WDKNKESANTAILFIKDDKYYLGIMDKKHNKIFSDKAIEENKGEG YKKIVYKQIADASKDIQNLMIIDGKTVCKKGRKDRNGVNRQLLSL KRKHLPENIYRIKETKSYLKNEARFSRKDLYDFIDYYKDRLDYYDF EFELKPSNEYSDFNDFTNHIGSQGYKLTFENISQDYINSLVNEGKLY LFQIYSKDFSAYSKGRPNLHTLYWKALFDERNLQDVVYKLNGEAE LFYRKQSIPKKITHPAKETIANKNKDNPKKESVFEYDLIKDKRFTED KFFFHCPITINFKSSGANKFNDEINLLLKEKANDVHILSIDRGERHLA YYTLVDGKGNIIKQDNFNIIGNDRMKTNYHDKLAAIEKDRDSARK DWKKINNIKEMKEGYLSQVVHEIAKLVIEYNAIVVFEDLNFGFKRG RFKVEKQVYQKLEKMLIEKLNYLVFKDNEFDKTGGVLRAYQLTA PFETFKKMGKQTGIIYYVPAGFTSKICPVTGFVNQLYPKYESVSKS QEFFSKFDKICYNLDKGYFEFSFDYKNFGDKAAKGKWTIASFGSRL INFRNSDKNHNWDTREVYPTKELEKLLKDYSIEYGHGECIKAAICG ESDKKFFAKLTSVLNTILQMRNSKTGTELDYLISPVADVNGNFFDS RQAPKNMPQDADANGAYHIGLKGLMLLDRIKNNQEGKKLNLVIK NEEYFEFVQNRNN |
| *Flavobacteriales bacterium* (FbCas12a) NCBI Gene ID: MBE7442138.1 | SEQ ID NO: 8 | MKNNNMLNFTNKYQLSKTLRFELKPIGKTKENIIAKNILKKDEERA ESYQLMKKTIDGFHKHFIELAMQEVQKTKLSELEEFAELYNKSAEE KKKDDKFDDKFKKVQEALRKEIVKGFNSEKVKYYYSNIDKKILFT ELLKNWIPNEKMITELSEWNAKTKEEKEHLVYLDKEFENFTTYFG GFHKNRENMYTDKEQSTAIAYRLIHENLPKFLDNINIYKKVKEIPV LREECKVLYKEIEEYLNVNSIDEVFELSYYNKTLTQKDIDVYNLIIG GRTLEEGKKKIQGLNEYINLYNQKQEKKNRIPKLKILYKQILSDRDS ISWLPESFEDDNEKTASQKVLEAINLYYRDNLLCFQPKDKKDTENV LEETKKLLAGLSTSDLSKIYIRNDRAITDISQALFKDYGVIKDALKF QFIQSFTIGKNGLSKKQEEAIEKHLKQKYFSIAEIENALFTYQSETDA LKELKENSHPVVDYFINHFKAKKKEETDKDFDLIANIDAKYSCIKG LLNTPYPKDKKLYQRSKGNDIDNIKAFLDALMELLHFVKPLALS NDSTLEKDQNFYSHFEPYYEQLELLIPLYNKVRNFAAKKPYSTEKF KLNFDNATLLNGWDKNKETDNTSVILRKDGLYYLAIMPQDNKNV FKDSPDLKANENCFEKMDYKQMALPMGFGAFVRKCFGTASQLG WNCPESCKNEEDKIIIKEDEVKNNRAEIIDCYKDFLNIYEKDGFQYK EYGFDFKESNKYESLREFFIDVEQQGYKITFQNISENYINQLVEDGK LYLFQIYNKDFSPYSKGKPNMHTMYWKALFDSENLKDVVYKLNG QAEVFYRKKSIEQKNIVTHKANEPIDNKNPKAKKKQSTFEYDLIKD KRYTVDKFQFHVPITLNFKATGNDYINQDVLTYLKNNPEVNIIGLD RGERHLIYLTLINQKGEILLQESLNTIVNKKYDIETPYHTLLQNKED ERAKARENWGVIENIKELKEGYISQVVHKIAKLMVEYNAIVVMED LNTGFKRGRFKVEKQVYQKLEKMLIDKLNYLVFKDKDPSEVGGL YHALQLTNKFENFSKIGKQSGFLFYVPAWNTSKIDPTTGFVNLFNT KYESVPKAQEFFKKFKSIKFNSAENYFEFAFDYNDFTTRAEGTKTD WIVCTYGDRIKTFRNPDKVNQWDNQEVNLTEQFEDFFGKNNLIYG DGNCIKNQIILHDKKEFFEGLLHLLKLTLQMRNSITNSEVDYLISPV KNNKGEFYDSRKANNTLPKDADANGAYHIAKKGLVLLNRLKENE VEEFEKSKKVKDGKSQWLPNKDWLDFVQRNVEDMVVV |
| *Lachnospira eligens* (Lb4Cas12a) NCBI Gene ID: MBS6299380.1 | SEQ ID NO: 9 | MNGNRSIVYREFVGVTPVAKTLRNELRPVGHTQEHIIQNGLIQEDE LRQEKSTELKNIMDDYYREYIDKSLSGVTDLDFTLLFELMNLVQSS PSKDNKKALEKEQSKMREQICTHLQSDSNYKNIFNAKLFKEILPDFI KNYNQYDVKDKAGKLETVALFNGFSTYFTDFFEKRKNVFTKEAV STSIAYRIVHENSLIFLANMTSYKKISEKALDEIEVIEKNNQDKMGD WELNQIFNPDFYNMVLIQSGIDFYNEICGVVNAHMNLYCQQTRNN YNLFKMRKLHKQILAYTSTSFEVPKMFEDDMSVYNAVNAFIDETE KGNIIVKLKDIVNKYDELDEKRIYISKDFYETLSCFISGNWNLITGC VENFYDENIHAKGKSKEEKVKKAVKEDKYKSINDVNDLVEKYIDE KERNEFKNSNAKQYIREISNIITDTETAHLEYDEHISLIESEEKADEM KKRLDMYMNMYHWAKAFIVDEVLDRDEMFYSDIDDIYNILENIVP LYNRVRNYVTQKPYSNKKIKLNFQSPTLANGWSQSKEFDNNAIILI RDNKYYLAIFNAKNKPDKKIIQGNSDKKNDNDYKKMVYNLLPGA |

TABLE 7-continued

Exemplary wild type Cas12a nucleic acid-guided nucleases

| Species Name Reference ID | SEQ ID NO: | Protein Sequence |
|---|---|---|
| | | NKMLPKVFLSKKGIETFKPSDYIISGYNAHKHIKTSENFDISFCRDLI DYFKNSIEKHAEWRKYEFKFSATDSYNDISEFYREVEMQGYRIDW TYISEADINKLDEEGKIYLFQIYNKYFAENSTGKENLHTMYFKNIFS EENLKDIIIKLNGQAELFYRRASVKNPVKHKKDSVLVNKTYKNQL DNGDVVRIPIPDDIYNEIYKMYNGYIKESDLSEAAKEYLDKVEVRT AQKDIVKDYRYTVDKYFIHTPITINYKVTARNNVNDMAVKYIAQN DDIHVIGIDRGERNLIYISVIDSHGNIVKQKSYNILNNYDYKKKLVE KEKTREYARKNWKSIGNIKELKEGYISGVVHEIAMLMVEYNAIIA MEDLNYGFKRGRFKVERQVYQKFESMLINKLNYFASKGKSVDEP GGLLRGYQLTYVPDNIKNLGKQCGVIFYVPAAFTSKIDPSTGFISAF NFKSISTNASRKQFFMQFDEIRYCAEKDMFSFGFDYNNFDTYNITM GKTQWTVYTNGERLQSEFNNARRTGKTKSINLTETIKLLLKDNKIN YADGHDVRIDMEKMDEDKNSEFFAQLLSLYKLTVQMRNSYTEAE EQEKGISYDKIISPVINDEGEFFDSDNYKESDDKECKMPKDADANG AYCIALKGLYEVLKIKSEWTEDGFDRNCLKLPHAEWLDFIQNKRY E |
| Moraxella bovoculi (MbCas12a) NCBI Gene ID: WP_046697655.1 | SEQ ID NO: 10 | MLFQDFTHLYPLSKTVRFELKPIGRTLEHIHAKNFLSQDETMADMY QKVKVILDDYHRDFIADMMGEVKLTKLAEFYDVYLKFRKNPKDD GLQKQLKDLQAVLRKESVKPIGSGGKYKTGYDRLFGAKLFKDGK ELGDLAKFVIAQEGESSPKLAHLAHFEKFSTYFTGFHDNRKNMYS DEDKHTAIAYRLIHENLPRFIDNLQILTTIKQKHSALYDQIINELTAS GLDVSLASHLDGYHKLLTQEGITAYNRIIGEVNGYTNKHNQICHKS ERIAKLRPLHKQILSDGMGVSFLPSKFADDSEMCQAVNEFYRHYT DVFAKVQSLFDGFDDHQKDGIYVEHKNLNELSKQAFGDFALLGR VLDGYYVDVVNPEFNERFAKAKTDNAKAKLTKEKDKFIKGVHSL ASLEQAIEHHTARHDDESVQAGKLGQYFKHGLAGVDNPIQKIHNN HSTIKGFLERERPAGERALPKIKSGKNPEMTQLRQLKELLDNALNV AHFAKLLTTKTTLDNQDGNFYGEFGVLYDELAKIPTLYNKVRDYL SQKPFSTEKYKLNFGNPTLLNGWDLNKEKDNFGVILQKDGCYYLA LLDKAHKKVFDNAPNTGKNVYQKMVYKLLPGPNKMLPKVFFAK SNLDYYNPSAELLDKYAKGTHKKGDNFNLKDCHALIDFFKAGINK HPEWQHGFGFKFSPTSSYRDLSDFYREVEPQGYQVKFVDINADYIDE LVEQGKLYLFQIYNKDFSPKAHGKPNLHTLYFKALFSEDNLADPIY KLNGEAQIFYRKASLDMNETTIHRAGEVLENKNPDNPKKRQFVYD IIKDKRYTQDKFMLHVPITMNFGVQGMTIKEFNKKVNQSIQQYDE VNVIGIDRGERHLLYLTVINSKGEILEQRSLNDITTASANGTQVTTP YHKILDKREIERLNARVGWGEIETIKELKSGYLSHVVHQINQLMLK YNAIVVLEDLNFGFKRGRFKVEKQIYQNFENALIKKLNHLVLKDK ADDEIGSYKNALQLTNNFTDLKSIGKQTGFLFYVPAWNTSKIDPET GFVDLLKPRYENIAQSQAFFGKFDKICYNTDKGYFEFHIDYAKFTD KAKNSRQKWAICSHGDKRYVYDKTANQNKGAAKGINVNDELKS LFARYHINDKQPNLVMDICQNNDKEFHKSLMCLLKTLLALRYSNA SSDEDFILSPVANDEGVFFNSALADDTQPQNADANGAYHIALKGL WLLNELKNSDDLNKVKLAIDNQTWLNFAQNR |
| Prevotella bryantii (Pb2Cas12a) NCBI Gene ID: WP_039871282.1 | SEQ ID NO: 11 | MKFTDFTGLYSLSKTLRFELKPIGKTLENIKKAGLLEQDQHRADSY KKVKKIIDEYHKAFIEKSLSNFELKYQSEDKLDSLEEYLMYYSMKR IEKTEKDKFAKIQDNLRKQIADHLKGDESYKTIFSKDLIRKNLPDFV KSDEERTLIKEFKDFTTYFKGFYENRENMYSAEDKSTAISHRIIHEN LPKFVDNINAFSKIILIPELREKLNQIYQDFEEYLNVESIDEIFHLDYF SMVMTQKQIEVYNAIIGGKSTNDKKIQGLNEYINLYNQKHKDCKL PKLKLLFKQILSDRIAISWLPDNFKDDQEALDSIDTCYKNLLNDGN VLGEGNLKLLLENIDTYNLKGIFIRNDLQLTDISQKMYASWNVIQD AVILDLKKQVSRKKKESAEDYNDRLKKLYTSQESFSIQYLNDCLR AYGKTENIQDYFAKLGAVNNEHEQTINLFAQVRNAYTSVQAILTTP YPENANLAQDKETVALIKNLLDSLKRLQRFIKPLLGKGDESDKDER FYGDFTPLWETLNQITPLYNMVRNYMTRKPYSQEKIKLNFENSTLL GGWDLNKEHDNTAIILRKNGLYYLAIMKKSANKIFDKDKLDNSGD CYEKMVYKLLPGANKMLPKVFFSKSRIDEFKPSENIIENYKKGTHK KGANFNLADCHNLIDFFKSSISKHEDWSKFNFHFSDTSSYEDLSDF YREVEQQGYSISFCDVSVEYINKMVEKGDLYLFQIYNKDFSEFSKG TPNMHTLYWNSLFSKENLNNIIYKLNGQAEIFFRKKSLNYKRPTHP AHQAIKNKNKCNEKKESIFDYDLVKDKRYTVDKFQPHVPITMNFK STGNTNINQQVIDYLRTEDDTHIIGIDRGERHLLYLVVIDSHGKIVE QFTLNEIVNEYGGNIYRTNYHDLLDTREQNREKARESWQTIENIKE LKEGYISQVIHKITDLMQKYHAVVVLEDLNMGFMRGRQKVEKQV YQKFEEMLINKLNYLVNKKADQNSAGGLLHAYQLTSKFESFQKLG KQSGFLFYIPAWNTSKIDPVTGFVNLFDTRYESIDKAKAFFGKFDSI RYNADKDWFEFAFDYNNFTTKAEGTRTNWTICTYGSRIRTFRNQA KNSQWDNEEIDLTKAYKAFFAKHGINIYDNIKEAIAMETEKSFFED LLHLLKLTQMRNSITGTTTDYLISPVHDSKGNFYDSRICDNSLPAN ADANGAYNIARKGLMLIQQIKDSTSSNRFKFSPITNKDWLIFAQEK PYLND |

TABLE 7-continued

Exemplary wild type Cas12a nucleic acid-guided nucleases

| Species Name Reference ID | SEQ ID NO: | Protein Sequence |
|---|---|---|
| *Candidatus Parcubacteria bacterium* (PgCas12a) NCBI Gene ID: BCX15829.1 | SEQ ID NO: 12 | MENKNNQTQSIWSVFTKKYSLQKTLRFELKPVGETKKWLEENDIF KKDLNIDKSYNQAKFYFDKLHQDFIKESLSVENGIRNIDFEKFAKIF ESNKEKIVSLKKKNKEVKDKNKKNWDEISKLEKEIEGQRENLYKEI RELFDKRAEKWKKEYQDKEIERGGKKEKIKFSSADLKQKGVNFLT AAGIINILKYKFPAEKDEEFRKEGYPSLFINDELNPGKKIYIFESFDK FTTYLSKFQQTRENLYKDDGTSTAVATRIVSNFERFLENKSLFEEK YKNKAKDVGLTKEEEKVFEINYYYDCLIQEGIDKYNKIIGEINRKT KEYRDKNKIDKKDLPLFLNLEKQILGEVKKERVFIEAKDEKTEEEV FIDRFQEFIKRNKIKIYGDEKEEIEGAKKFIEDFTSGIFENDYQSIYLK KNVINEIVNKWFSNPEEFLMKLTGVKSEEKIKLKKFTSLDEFKNAIL SLEGDIFKSRFYKNEVNPEAPLEKEEKSNNWENFLKIWRFEFESLFK DKVEKGEIKDKNGEPIQIFWGYTDKLEKEAEKIKFYSAEKEQIKTI KNYCDAALRINRMMRYFNLSDKDRKDVPSGLSTEFYRLVDEYFN NFEFNKYYNGIRNFITKKPSDENKIKLNFESRSLLDGWDVSKEKDN LGLIFIKNNKYYLGVLRKENSKLFDYQITEKDNQKEKERKNNLKNE ILANDNEDFYLKMNYWQIADPAKDIFNLVLMPDNTVKRFTKLEEK NKHWPDEIKRIKEKGTYKREKVNREDLVKIINYFRKCALIYWKKF DLKLLPSEEYQTFKDFTDHIALQGYKINFDKIKASYIEKQLNDGNL YLFEVSNKDFYKYKKPDSRKNIHTLYWEHIFSKENLEEIKYPLIRLN GKAEIFYRDVLEMNEEMRKPVILERLNGAKQAKREDKPVYHYQR YLKPTYLFHCPITLNADKPSSSFKNFSSKLNHFIKDNLGKINIIGIDR GEKNLLYYCVINQNQEILDYGSLNKINLNKVNNVNYFDKLVEREK QRQLERQSWEPVAKIKDLKQGYISYVVRKICDLIINHNAIVVLEDLS RRFKQIRNGISERTVYQQFEKALIDKLNYLIFKDNRDVFSPGGVLN GYQLAAPFTSFKDIEKAKQTGVLFYTSAEYTSQTDPLTGFRKNIYIS NSASQEKIKELINKLKKFGWDDTEESYFIEYNQVDFAEKKKKPLSK DWTIWTKVPRVIRWKESKSSYWSYKKINLNEEFRDLLEKYGFEAQ SNDILSNLKKRIAENDKLLVEKKEFDGRLKNFYERFIFLFNIVLQVR NTYSLSVEIDKTEKKLKKIDYGIDFFASPVKPFFTTFGLREIGIEKDG KVVKDNAREEIASENLAEFKDRLKEYKPEEKFDADGVGAYNIARK GLIILEKIKNNPNKPDLSISKEEWDKFVQR |
| *Acidaminococcus* sp. (AaCas12a) NCBI Gene ID: WP_021736722.1 | SEQ ID NO: 13 | MTQFEGFTNLYQVSKTLRFELIPQGKTLKHIQEQGFIEEDKARNDH YKELKPIIDRIYKTYADQCLQLVQLDWENLSAAIDSYRKEKTEETR NALIEEQATYRNAIHDYFIGRTDNLTDAINKRHAEIYKGLFKAELFN GKVLKQLGTVTTTEHENALLRSFDKFTTYFSGFYENRKNVFSAEDI STAIPHRIVQDNFPKFKENCHIFTRLITAVPSLREHFENVKKAIGIFV STSIEEVFSFPFPFYNQLLTQTQIDLYNQLLGGISREAGTEKIKGLNEVL NLAIQKNDETAHIIASLPHRFIPLFKQILSDRNTLSFILEEFKSDEEVI QSFCKYKTLLRNENVLETAEALFNELNSIDLTHIFISHKKLETISSAL CDHWDTLRNALYERRISELTGKITKSAKEKVQRSLKHEDINLQEIIS AAGKELSEAFKQKTSEILSHAHAALDQPLPTTLKKQEEKEILKSQL DSLLGLYHLLDWFAVDESNEVDPEFSARLTGIKLEMEPSLSFYNKA RNYATKKPYSVEKFKLNFQMPTLASGWDVNKEKNNGAILFVKNG LYYLGIMPKQKGRYKALSFEPTEKTSEGFDKMYYDYFPDAAKMIP KCSTQLKAVTAHFQTHTTPILLSNNFIEPLEITKEIYDLNNPEKEPKK FQTAYAKKTGDQKGYREALCKWIDFTRDFLSKYTKTTSIDLSSLRP SSQYKDLGEYYAELNPLLYHISFQRIAEKEIMDAVETGKLYLFQIY NKDFAKGHHGKPNLHTLYWTGLFSPENLAKTSIKLNGQAELFYRP KSRMKRMAHRLGEKMLNKKLKDQKTPIPDTLYQELYDYVNHRLS HDLSDEARALLPNVITKEVSHEIIKDRRFTSDKFFFHVPITLNYQAA NSPSKFNQRVNAYLKEHPETPIIGIDRGERNLIYITVIDSTGKILEQRS LNTIQQFDYQKKLDNREKERVAARQAWSVVGTIKDLKQGYLSQVI HEIVDLMIHYQAVVVLENLNFGFKSKRTGIAEKAVYQQFEKMLID KLNCLVLKDYPAEKVGGVLNPYQLTDQFTSFAKMGTQSGFLFYVP APYTSKIDPLTGFVDPFVWKTIKNHESRKHFLEGFDFLHYDVKTGD FILHFKMNRNLSFQRGLPGFMPAWDIVFEKNETQFDAKGTPFIAGK RIVPVIENHRFTGRYRDLYPANELIALLEEKGIVFRDGSNILPKLLEN DDSHAIDTMVALIRSVLQMRNSNAATGEDYINSPVRDLNGVCFDS RFQNPEWPMDADANGAYHIALKGQLLLNHLKESKDLKLQNGISN QDWLAYIQELRN |
| *Bacteroidetes bacterium* (BoCas12a) NCBI Gene ID: PKP47250.1 | SEQ ID NO: 14 | MESPTTQLKKFTNLYQLSKTLRFELKPVGKTKEHIETKGILKKDEE RAVNYKLIKKIIDGFHKHFIELAMQQVKLSKLDELAELYNASAERK KEESYKKELEQVQAALRKEIVKGFNIGEAKEIFSKIDKKELFTELLD EWVKNLEEKKLVDDFKTFTTYFTGFHENRKNMYTDKAQSTAIAY RLVHENLPKFLDNTKIFKQIETKFEASKIEEEIETKLEPIIQGTSLSEIFT LDYYNHALTQAGIDFINNIIGGYTEDEGKKKIQGLNEYINLYNQKQ EKKNRIPKLKILYKQILSDRDSISFLPDAFEDSQEVLNAIQNYYQTN LIDFKPKDEETENVLEETKKLLTELFSNELSKIYIRNDKAITDISQA LFNDWGVFKSALEYKFIQDLELGTKELSKKQENEKEKYLKQAYFSI AEIENALFAYQNETDVLNEIKENSHPIADYFTKHFKAKKKVDTSTS SVEKDFDLIANIDAKYSCIKGILNTDYPKDKKLNQEKKTIDDLKVFL |

TABLE 7-continued

Exemplary wild type Cas12a nucleic acid-guided nucleases

| Species Name Reference ID | SEQ ID NO: | Protein Sequence |
|---|---|---|
| | | DSLMELLHFVKPLALPNDSILEKDENFYSHFESYYEQLELLIPLYNK VRNYAAKKPYSTEKFKLNFENATLLKGWDKNKEIDNTSVILRKRG LYYLAIMPQDNKNVFKKSPNLKNNESCFEKMDYKQMALPMGFGA FVRKCFGTAFQLGWNCPKSCINEEDKIIIKEDEVKNNRAEIIDCYKD FLNIYEKDGFQYKEYGFNFKESKEYESLREFFIDVEQKGYKIEFQNI SENYIHQLVNEGKLYLFQIYNKDFSSYSKGKPNMHTMYWKALFDP ENLKDVVYKLNGQAEVFYRKKSIEDKNIITHKANEPIENKNPKAKK TQSTFEYDLIKDKRYTVDKFHFHVPITINFKATGNNYINQQVLDHL KNNTDVNIIGLDRGERHLIYLTLINQKGEILLQESLNTIVNKKFDIET PYHTLLQNKEDERAKARENWGVIENIKELKEGYLSQVVHKIAKLM VDYNAIVVMEDLNTGFKRGRFKVEKQVYQKLEKMLIDKLNYLVF KDKDPNEVGGLYNALQLTNKFESFSKMGKQSGFLFYVPAWNTSKI DPTTGFVNLFYAKYESIPKAQDFFTKFKSIRYNSDENYFEFAFDYN DFTTRAEGTKSDWTVCTYGDRIKTFRNPEKNNQWDNQEVNLIEQF EAFFGKHNITYGDGNCIKKQLIEQDKKEFFEELFHLFKLTLQMRNSI TNSEIDYLISPVKNSKKEFYDSRKADSTLPKDADANGAYHIAKKGL MWLEKINSFKGSDWKKLDLDKTNKTWLNFVQETASEKHKKLQTV |
| Candidatus Methanomethylop hilus alvus Mx1201 (CMaCas12a) NCBI Gene ID: 15139718 | SEQ ID NO: 15 | MDAKEFTGQYPLSKTLRFELRPIGRTWDNLEASGYLAEDRHRAEC YPRAKELLDDNHRAFLNRVLPQIDMDWHPIAEAFCKVHKNPGNK ELAQDYNLQLSKRRKEISAYLQDADGYKGLFAKPALDEAMKIAKE NGNESDIEVLEAFNGFSVYFTGYHESRENIYSDEDMVSVAYRITED NFPRFVSNALIFDKLNESHPDIISEVSGNLGVDDIGKYFDVSNYNNF LSQAGIDDYNHIIGGHTTEDGLIQAFNVVLNLRHQKDPGFEKIQFK QLYKQILSVRTSKSYIPKQFDNSKEMVDCICDYVSKIEKSETVERAL KLVRNISSFDLRGIFVNKKNLRILSNKLIGDWDAIETALMHSSSSEN DKKSVYDSAEAFTLDDIFSSVKKFSDASAEDIGNRAEDICRVISETA PFINDLRAVDLDSLNDDGYEAAVSKIRESLEPYMDLFHELEIFSVG DEFPKCAAFYSELEEVSEQLIEIIPLFNKARSFCTRKRYSTDKIKVNL KFPTLADGWDLNKERDNKAAILRKDGKYYLAILDMKKDLSSIRTS DEDESSFEKMEYKLLPSPVKMLPKIFVKSKAAKEKYGLTDRMLEC YDKGMHKSGSAFDLGFCHELIDYYKRCIAEYPGWDVFDFKFRETS DYGSMKEFNEDVAGAGYYMSLRKIPCSEVYRLLDEKSIYLFQIYN KDYSENAHGNKNMHTMYWEGLFSPQNLESPVFKLSGGAELFFRK SSIPNDAKTVHPKGSVLVPRNDVNGRRIPDSIYRELTRYFNRGDCRI SDEAKSYLDKVKTKKADHDIVKDRRFTVDKMMFHVPIAMNFKAI SKPNLNKKVIDGIIDDQDLKIIGIDRGERNLIYVTMVDRKGNILYQD SLNILNGYDYRKALDVREYDNKEARRNWTKVEGIRKMKEGYLSL AVSKLADMIIENNAIIVMEDLNHGFKAGRSKIEKQVYQKFESMLIN KLGYMVLKDKSIDQSGGALHGYQLANHVTTLASVGKQCGVIFYIP AAFTSKIDPTTGFADLFALSNVKNVASMREFFSKMKSVIYDKAEG KFAFTFDYLDYNVKSECGRTLWTVYTVGERFTYSRVNREYVRKV PTDIIYDALQKAGISVEGDLRDRIAESDGDTLKSIFYAFKYALDMR VENREEDYIQSPVKNASGEFFCSKNAGKSLPQDSDANGAYNIALK GILQLRMLSEQYDPNAESIRLPLITNKAWLTFMQSGMKTWKN |

In some embodiments, the single-strand-specific Cas12a nucleic acid-guided nuclease contains one or more of the following substitutions (aligned with LbCas12a): K538A, K538D, K538E, Y542A, Y542D, Y542E, or K595A, K595D, K595E relative to the amino acid sequence of SEQ ID NO: 1.

In some embodiments, the single-strand-specific Cas12a nucleic acid-guided nuclease contains one or more of the following substitutions (aligned with AsCas12a): K548A, K548D, K548E, N552A, N552D, N552E, or K607A, K607D, K607 relative to the amino acid sequence of SEQ ID NO: 2.

In some embodiments, the single-strand-specific Cas12a nucleic acid-guided nuclease contains one or more of the following substitutions (aligned with CtCas12a): K534A, K534D, K534E, Y538A, Y538D, Y538E, or R591A, R591D, R591E relative to the amino acid sequence of SEQ ID NO: 3.

In some embodiments, the single-strand-specific Cas12a nucleic acid-guided nuclease contains one or more of the following substitutions (aligned with EeCas12a): K542A, K541D, K541E, N545A, N545D, N545E or K601A, K601D, K601E relative to the amino acid sequence of SEQ ID NO: 4.

In some embodiments, the single-strand-specific Cas12a nucleic acid-guided nuclease contains one or more of the following substitutions (aligned with Mb3Cas12a): K579A, K579D, K579E, N583A, N583D, N583E or K635A, K635D, K635E relative to the amino acid sequence of SEQ ID NO: 5.

In some embodiments, the single-strand-specific Cas12a nucleic acid-guided nuclease contains one or more of the following substitutions (aligned with FnCas12a): K613A, K613D, K613E, N617A, N617D, N617E or K671A, K671D, K671E relative to the amino acid sequence of SEQ ID NO: 6.

In some embodiments, the single-strand-specific Cas12a nucleic acid-guided nuclease contains one or more of the following substitutions (aligned with FnoCas12a): K613A, K613D, K613E, N617A, N617D, N617E or N671A, N671D, N671E relative to the amino acid sequence of SEQ ID NO: 7.

In some embodiments, the single-strand-specific Cas12a nucleic acid-guided nuclease contains one or more of the following substitutions (aligned with FbCas12a): K617A, K617D, K617E, N621A, N621D, N621E or K678A, K678D, K678E relative to the amino acid sequence of SEQ ID NO: 8.

In some embodiments, the single-strand-specific Cas12a nucleic acid-guided nuclease contains one or more of the following substitutions (aligned with Lb4Cas12a): K541A, K541D, K541E, N545A, N545D, N545E or K601A, K601D, K601E relative to the amino acid sequence of SEQ ID NO: 9.

In some embodiments, the single-strand-specific Cas12a nucleic acid-guided nuclease contains one or more of the following substitutions (aligned with MbCas12a): K569A, K569D, K569E, N573A, N573D, N573E or K625A, K625D, K625E relative to the amino acid sequence of SEQ ID NO: 10.

In some embodiments, the single-strand-specific Cas12a nucleic acid-guided nuclease contains one or more of the following substitutions (aligned with Pb2Cas12a): K562A, K562D, K562E, N566A, N566D, N566E or K619A, K619D, K619E relative to the amino acid sequence of SEQ ID NO: 11.

In some embodiments, the single-strand-specific Cas12a nucleic acid-guided nuclease contains one or more of the following substitutions (aligned with PgCas12a): K645A, K645D, K645E, N649A, N649D, N649E or K732A, K732D, K732E relative to the amino acid sequence of SEQ ID NO: 12.

In some embodiments, the single-strand-specific Cas12a nucleic acid-guided nuclease contains one or more of the following substitutions (aligned with AaCas12a): K548A, K548D, K548E, N552A, N552D, N552E or K607A, K607D, K607E relative to the amino acid sequence of SEQ ID NO: 13.

In some embodiments, the single-strand-specific Cas12a nucleic acid-guided nuclease contains one or more of the following substitutions (aligned with BoCas12a): K592A, K592D, K592E, N596A, N596D, N596E or K653A, K653D, K653E relative to the amino acid sequence of SEQ ID NO: 14.

In some embodiments, the single-strand-specific Cas12a nucleic acid-guided nuclease contains one or more of the following substitutions (aligned with CMaCas12a): K521A, K521D, K521E, K525A, K525D, K525E or K577A, K577D, K577E relative to the amino acid sequence of SEQ ID NO: 15.

The mutations described herein may be described in the context of a natural Cas12a (any one of SEQ ID NOs: 15) sequence and mutational positions can be carried out by aligning the amino acid sequence of a Cas12a nucleic acid-guided nuclease with, for example, SEQ ID NO: 1 and making the equivalent modification (e.g., substitution) at the equivalent position. By way of example, Table 8 illustrates the equivalent amino acid positions of fifteen orthologous Cas12a nucleic acid-guided nucleases (SEQ ID NOs: 1-15). Any one of the amino acids indicated in Table 8 may be mutated (i.e., via a comparable amino acid substitution).

TABLE 8

Equivalent amino acid positions in homologous Cas12a nucleic acid-guided nuclease

| WT SEQ ID NO | Cas 12a Ortholog | AA position | AA position | AA position | AA position |
|---|---|---|---|---|---|
| SEQ ID NO: 1 | LbCas12a | G532 | K538 | Y542 | K595 |
| SEQ ID NO: 2 | AsCas12a | S542 | K548 | N552 | K607 |
| SEQ ID NO: 3 | CtCas12a | N528 | K534 | Y538 | R591 |
| SEQ ID NO: 4 | EeCas12a | N535 | K541 | N545 | K601 |
| SEQ ID NO: 5 | Mb3Cas12a | N573 | K579 | N583 | K635 |
| SEQ ID NO: 6 | FnCas12a | N607 | K613 | N617 | K671 |
| SEQ ID NO: 7 | FnoCas12a | N607 | K613 | N617 | N671 |
| SEQ ID NO: 8 | FbCas12a | N611 | K617 | N621 | K678 |
| SEQ ID NO: 9 | Lb4Cas12a | N535 | K541 | N545 | K601 |
| SEQ ID NO: 10 | MbCas12a | N563 | K569 | N573 | K625 |
| SEQ ID NO: 11 | Pb2Cas12a | G556 | K562 | N566 | K619 |
| SEQ ID NO: 12 | PgCas12a | D639 | K645 | N649 | K732 |
| SEQ ID NO: 13 | AaCas12a | S542 | K548 | N552 | K607 |
| SEQ ID NO: 14 | BoCas12a | K586 | K592 | N596 | K653 |
| SEQ ID NO: 15 | CMaCas12a | D515 | K521 | N525 | K577 |

The variant single-strand-specific Cas12a nucleic acid-guided nucleases of the disclosure may have at least 70%, at least 75%, at least 80%, at least 85%, at least 90%, at least 95%, at least 96%, at least 97%, at least 98%, or at least 99% sequence identity to any one of SEQ ID NOs: 1-15 (excluding the residues listed in Table 8) and contain any conservative mutation one or more residues indicated in Tables 9-13.

It should be appreciated that any of the amino acid mutations described herein, (e.g., K595A) from a first amino acid residue (e.g., K, an amino acid with a basic side chain) to a second amino acid residue (e.g., A, an amino acid with an aliphatic side chain) may also include mutations from the first amino acid residue, lysine, to an amino acid residue that is similar to (e.g., conserved) the second amino acid residue, alanine, such as valine or glycine. As another example, mutation of an amino acid with a positively charged side chain (e.g., arginine, histidine, or lysine) may be a mutation to a second amino acid with an acidic side chain (e.g., glutamic acid or aspartic acid). As another example, mutation of an amino acid with a polar side chain (e.g., serine, threonine, asparagine, or glutamine) may be a mutation to a second amino acid with a positively charged side chain (e.g., arginine, histidine, or lysine). The skilled artisan would recognize that such conservative amino acid substitutions will likely have minor effects on protein structure and are likely to be well tolerated without compromising function. That is, a mutation from one amino acid to a threonine may be an amino acid mutation to a serine; a mutation from one amino acid to an arginine may be an amino acid mutation to a lysine; a mutation from one amino acid to an isoleucine, may be an amino acid mutation to an alanine, valine, methionine, or leucine; a mutation from one amino acid to a lysine may be an amino acid mutation to an arginine; a mutation from one amino acid to an aspartic acid may be an amino acid mutation to a glutamic acid or asparagine; a mutation from one amino acid to a valine may be an amino acid mutation to an alanine, isoleucine, methionine, or leucine; a mutation from one amino acid to a glycine may be an amino acid mutation to an alanine. It should be appreciated, however, that additional conserved amino acid residues would be recognized by the skilled artisan and any of the amino acid mutations to other conserved amino acid residues are also within the scope of this disclosure.

Exemplary variant Cas12a orthologs are shown in tables 9-13.

TABLE 9

Exemplary Variant Ortholog Cas12a's

| SEQ ID NO: | Variant LbCas12a (in relation to wt LbCas12a SEQ ID NO:1) | SEQ ID NO: | Variant AsCas12a (in relation to wt AsCas12a SEQ ID NO:2) | SEQ ID NO: | Variant CtCas12a (in relation to wt CtCas12a SEQ ID NO:3) |
|---|---|---|---|---|---|
| 16 | K595A | 55 | K607A | 94 | R591A |
| 17 | K595D | 56 | K607D | 95 | R591D |
| 18 | K595E | 57 | K607E | 96 | R591E |
| 19 | K538A/K595A | 58 | K548A/K607A | 97 | K534A/R591A |
| 20 | K538A/K595D | 59 | K548A/K607D | 98 | K534A/R591D |
| 21 | K538A/K595E | 60 | K548A/K607E | 99 | K534A/R591E |
| 22 | K538D/K595A | 61 | K548D/K607A | 100 | K534D/R591A |
| 23 | K538D/K595D | 62 | K548D/K607D | 101 | K534D/R591D |
| 24 | K538D/K595E | 63 | K548D/K607E | 102 | K534D/R591E |
| 25 | K538E/K595A | 64 | K548E/K607A | 103 | K534E/R591A |
| 26 | K538E/K595D | 65 | K548E/K607D | 104 | K534E/R591D |
| 27 | K538E/K595E | 66 | K548E/K607E | 105 | K534E/R591E |
| 28 | K538A/Y542A/K595A | 67 | K548A/N552A/K607A | 106 | K534A/Y538A/R591A |
| 29 | K538A/Y542D/K595A | 68 | K548A/N552D/K607A | 107 | K534A/Y538D/R591A |
| 30 | K538A/Y542E/K595A | 69 | K548A/N552E/K607A | 108 | K534A/Y538E/R591A |
| 31 | K538A/Y542A/K595D | 70 | K548A/N552A/K607D | 109 | K534A/Y538A/R591D |
| 32 | K538A/Y542D/K595D | 71 | K548A/N552D/K607D | 110 | K534A/Y538D/R591D |
| 33 | K538A/Y542E/K595D | 72 | K548A/N552E/K607D | 111 | K534A/Y538E/R591D |
| 34 | K538A/Y542A/K595E | 73 | K548A/N552A/K607E | 112 | K534A/Y538A/R591E |
| 35 | K538A/Y542D/K595E | 74 | K548A/N552D/K607E | 113 | K534A/Y538D/R591E |
| 36 | K538A/Y542E/K595E | 75 | K548A/N552E/K607E | 114 | K534A/Y538E/R591E |
| 37 | K538D/Y542A/K595A | 76 | K548D/N552A/K607A | 115 | K534D/Y538A/R591A |
| 38 | K538D/Y542D/K595A | 77 | K548D/N552D/K607A | 116 | K534D/Y538D/R591A |
| 39 | K538D/Y542E/K595A | 78 | K548D/N552E/K607A | 117 | K534D/Y538E/R591A |
| 40 | K538D/Y542A/K595D | 79 | K548D/N552A/K607D | 118 | K534D/Y538A/R591D |
| 41 | K538D/Y542D/K595D | 80 | K548D/N552D/K607D | 119 | K534D/Y538D/R591D |
| 42 | K538D/Y542E/K595D | 81 | K548D/N552E/K607D | 120 | K534D/Y538E/R591D |
| 43 | K538D/Y542A/K595E | 82 | K548D/N552A/K607E | 121 | K534D/Y538A/R591E |
| 44 | K538D/Y542D/K595E | 83 | K548D/N552D/K607E | 122 | K534D/Y538D/R591E |
| 45 | K538D/Y542E/K595E | 84 | K548D/N552E/K607E | 123 | K534D/Y538E/R591E |
| 46 | K538E/Y542A/K595A | 85 | K548E/N552A/K607A | 124 | K534E/Y538A/R591A |
| 47 | K538E/Y542D/K595A | 86 | K548E/N552D/K607A | 125 | K534E/Y538D/R591A |
| 48 | K538E/Y542E/K595A | 87 | K548E/N552E/K607A | 126 | K534E/Y538E/R591A |
| 49 | K538E/Y542A/K595E | 88 | K548E/N552A/K607D | 127 | K534E/Y538A/R591D |
| 50 | K538E/Y542D/K595E | 89 | K548E/N552D/K607D | 128 | K534E/Y538D/R591D |
| 51 | K538E/Y542E/K595E | 90 | K548E/N552E/K607D | 129 | K534E/Y538E/R591D |
| 52 | K538E/Y542A/K595E | 91 | K548E/N552A/K607E | 130 | K534E/Y538A/R591E |
| 53 | K538E/Y542D/K595E | 92 | K548E/N552D/K607E | 131 | K534E/Y538D/R591E |
| 54 | K538E/Y542E/K595E | 93 | K548E/N552E/K607E | 132 | K534E/Y538E/R591E |

TABLE 10

Exemplary Variant Ortholog Cas12a's

| SEQ ID NO: | Variant EeCas12a (in relation to wt EeCas12a SEQ ID NO:4) | SEQ ID NO: | Variant Mb3Cas12a (in relation to wt Mb3Cas12a SEQ ID NO:5) | SEQ ID NO: | Variant FnCas12a (in relation to wt FnCas12a SEQ ID NO:6) |
|---|---|---|---|---|---|
| 133 | K601A | 172 | K635A | 211 | K671A |
| 134 | K601D | 173 | K635D | 212 | K671D |
| 135 | K601E | 174 | K635E | 213 | K671E |
| 136 | K541A/K601A | 175 | K579A/K635A | 214 | K613A/K671A |
| 137 | K541A/K601D | 176 | K579A/K635D | 215 | K613A/K671D |
| 138 | K541A/K601E | 177 | K579A/K635E | 216 | K613A/K671E |
| 139 | K541D/K601A | 178 | K579D/K635A | 217 | K613D/K671A |
| 140 | K541D/K601D | 179 | K579D/K635D | 218 | K613D/K671D |
| 141 | K541D/K601E | 180 | K579D/K635E | 219 | K613D/K671E |
| 142 | K541E/K601A | 181 | K579E/K635A | 220 | K613E/K671A |
| 143 | K541E/K601D | 182 | K579E/K635D | 221 | K613E/K671D |
| 144 | K541E/K601E | 183 | K579E/K635E | 222 | K613E/K671E |
| 145 | K541A/N545A/K601A | 184 | K579A/N583A/K635A | 223 | K613A/N617A/K671A |
| 146 | K541A/N545D/K601A | 185 | K579A/N583D/K635A | 224 | K613A/N617D/K671A |
| 147 | K541A/N545E/K601A | 186 | K579A/N583E/K635A | 225 | K613A/N617E/K671A |
| 148 | K541A/N545A/K601D | 187 | K579A/N583A/K635D | 226 | K613A/N617A/K671D |
| 149 | K541A/N545D/K601D | 188 | K579A/N583D/K635D | 227 | K613A/N617D/K671D |
| 150 | K541A/N545E/K601D | 189 | K579A/N583E/K635D | 228 | K613A/N617E/K671D |
| 151 | K541A/N545A/K601E | 190 | K579A/N583A/K635E | 229 | K613A/N617A/K671E |
| 152 | K541A/N545D/K601E | 191 | K579A/N583D/K635E | 230 | K613A/N617D/K671E |

TABLE 10-continued

Exemplary Variant Ortholog Cas12a's

| SEQ ID NO: | Variant EeCas12a (in relation to wt EeCas12a SEQ ID NO:4) | SEQ ID NO: | Variant Mb3Cas12a (in relation to wt Mb3Cas12a SEQ ID NO:5) | SEQ ID NO: | Variant FnCas12a (in relation to wt FnCas12a SEQ ID NO:6) |
|---|---|---|---|---|---|
| 153 | K541A/N545E/K601E | 192 | K579A/N583E/K635E | 231 | K613A/N617E/K671E |
| 154 | K541D/N545A/K601A | 193 | K579D/N583A/K635A | 232 | K613D/N617A/K671A |
| 155 | K541D/N545D/K601A | 194 | K579D/N583D/K635A | 233 | K613D/N617D/K671A |
| 156 | K541D/N545E/K601A | 195 | K579D/N583E/K635A | 234 | K613D/N617E/K671A |
| 157 | K541D/N545A/K601D | 196 | K579D/N583A/K635D | 235 | K613D/N617A/K671D |
| 158 | K541D/N545D/K601D | 197 | K579D/N583D/K635D | 236 | K613D/N617D/K671D |
| 159 | K541D/N545E/K601D | 198 | K579D/N583E/K635D | 237 | K613D/N617E/K671D |
| 160 | K541D/N545A/K601E | 199 | K579D/N583A/K635E | 238 | K613D/N617A/K671E |
| 161 | K541D/N545D/K601E | 200 | K579D/N583D/K635E | 239 | K613D/N617D/K671E |
| 162 | K541D/N545E/K601E | 201 | K579D/N583E/K635E | 240 | K613D/N617E/K671E |
| 163 | K541E/N545A/K601A | 202 | K579E/N583A/K635A | 241 | K613E/N617A/K671A |
| 164 | K541E/N545D/K601A | 203 | K579E/N583D/K635A | 242 | K613E/N617D/K671A |
| 165 | K541E/N545E/K601A | 204 | K579E/N583E/K635A | 243 | K613E/N617E/K671A |
| 166 | K541E/N545A/K601D | 205 | K579E/N583A/K635D | 244 | K613E/N617A/K671D |
| 167 | K541E/N545D/K601D | 206 | K579E/N583D/K635D | 245 | K613E/N617D/K671D |
| 168 | K541E/N545E/K601D | 207 | K579E/N583E/K635D | 246 | K613E/N617E/K671D |
| 169 | K541E/N545A/K601E | 208 | K579E/N583A/K635E | 247 | K613E/N617A/K671E |
| 170 | K541E/N545D/K601E | 209 | K579E/N583D/K635E | 248 | K613E/N617D/K671E |
| 171 | K541E/N545E/K601E | 210 | K579E/N583E/K635E | 249 | K613E/N617E/K671E |

TABLE 11

Exemplary Variant Ortholog Cas12a's

| SEQ ID NO: | Variant FnoCas12a (in relation to wt FnoCas12a SEQ ID NO:7) | SEQ ID NO: | Variant FbCas12a (in relation to wt FbCas12a SEQ ID NO:8) | SEQ ID NO: | Variant Lb4asl2a (in relation to wt Lb4Cas12a SEQ ID NO:9) |
|---|---|---|---|---|---|
| 250 | N671A | 289 | K678A | 328 | K601A |
| 251 | N671D | 290 | K678D | 329 | K601D |
| 252 | N671E | 291 | K678E | 330 | K601E |
| 253 | K613A/N671A | 292 | K617A/K678A | 331 | K541A/K601A |
| 254 | K613A/N671D | 293 | K617A/K678D | 332 | K541A/K601D |
| 255 | K613A/N671E | 294 | K617A/K678E | 333 | K541A/K601E |
| 256 | K613D/N671A | 295 | K617D/K678A | 334 | K541D/K601A |
| 257 | K613D/N671D | 296 | K617D/K678D | 335 | K541D/K601D |
| 258 | K613D/N671E | 297 | K617D/K678E | 336 | K541D/K601E |
| 259 | K613E/N671A | 298 | K617E/K678A | 337 | K541E/K601A |
| 260 | K613E/N671D | 299 | K617E/K678D | 338 | K541E/K601D |
| 261 | K613E/N671E | 300 | K617E/K678E | 339 | K541E/K601E |
| 262 | K613A/N617A/N671A | 301 | K617A/N621A/K678A | 340 | K541A/N545A/K601A |
| 263 | K613A/N617D/N671A | 302 | K617A/N621D/K678A | 341 | K541A/N545D/K601A |
| 264 | K613A/N617E/N671A | 303 | K617A/N621E/K678A | 342 | K541A/N545E/K601A |
| 265 | K613A/N617A/N671D | 304 | K617A/N621A/K678D | 343 | K541A/N545A/K601D |
| 266 | K613A/N617D/N671D | 305 | K617A/N621D/K678D | 344 | K541A/N545D/K601D |
| 267 | K613A/N617E/N671D | 306 | K617A/N621E/K678D | 345 | K541A/N545E/K601D |
| 268 | K613A/N617A/N671E | 307 | K617A/N621A/K678E | 346 | K541A/N545A/K601E |
| 269 | K613A/N617D/N671E | 308 | K617A/N621D/K678E | 347 | K541A/N545D/K601E |
| 270 | K613A/N617E/N671E | 309 | K617A/N621E/K678E | 348 | K541A/N545E/K601E |
| 271 | K613D/N617A/N671A | 310 | K617D/N621A/K678A | 349 | K541D/N545A/K601A |
| 272 | K613D/N617D/N671A | 311 | K617D/N621D/K678A | 350 | K541D/N545D/K601A |
| 273 | K613D/N617E/N671A | 312 | K617D/N621E/K678A | 351 | K541D/N545E/K601A |
| 274 | K613D/N617A/N671D | 313 | K617D/N621A/K678D | 352 | K541D/N545A/K601D |
| 275 | K613D/N617D/N671D | 314 | K617D/N621D/K678D | 353 | K541D/N545D/K601D |
| 276 | K613D/N617E/N671D | 315 | K617D/N621E/K678D | 354 | K541D/N545E/K601D |
| 277 | K613D/N617A/N671E | 316 | K617D/N621A/K678E | 355 | K541D/N545A/K601E |
| 278 | K613D/N617D/N671E | 317 | K617D/N621D/K678E | 356 | K541D/N545D/K601E |
| 279 | K613D/N617E/N671E | 318 | K617D/N621E/K678E | 357 | K541D/N545E/K601E |
| 280 | K613E/N617A/N671A | 319 | K617E/N621A/K678A | 358 | K541E/N545A/K601A |
| 281 | K613E/N617D/N671A | 320 | K617E/N621D/K678A | 359 | K541E/N545D/K601A |
| 282 | K613E/N617E/N671A | 321 | K617E/N621E/K678A | 360 | K541E/N545E/K601A |
| 283 | K613E/N617A/N671D | 322 | K617E/N621A/K678D | 361 | K541E/N545A/K601D |
| 284 | K613E/N617D/N671D | 323 | K617E/N621D/K678D | 362 | K541E/N545D/K601D |
| 285 | K613E/N617E/N671D | 324 | K617E/N621E/K678D | 363 | K541E/N545E/K601D |
| 286 | K613E/N617A/N671E | 325 | K617E/N621A/K678E | 364 | K541E/N545A/K601E |
| 287 | K613E/N617D/N671E | 326 | K617E/N621D/K678E | 365 | K541E/N545D/K601E |
| 288 | K613E/N617E/N671E | 327 | K617E/N621E/K678E | 366 | K541E/N545E/K601E |

TABLE 12

Exemplary Variant Ortholog Cas12a's

| SEQ ID NO: | Variant MbCas12a (in relation to wt MbCas12a SEQ ID NO:10) | SEQ ID NO: | Variant Pb2Cas12a (in relation to wt Pb2Cas12a SEQ ID NO:11) | SEQ ID NO: | Variant PgCas12a (in relation to wt PgCas12a SEQ ID NO:12) |
|---|---|---|---|---|---|
| 367 | K625A | 406 | K619A | 445 | K732A |
| 368 | K625D | 407 | K619D | 446 | K732D |
| 369 | K625E | 408 | K619E | 447 | K732E |
| 370 | K569A/K625A | 409 | K562A/K619A | 448 | K645A/K732A |
| 371 | K569A/K625D | 410 | K562A/K619D | 449 | K645A/K732D |
| 372 | K569A/K625E | 411 | K562A/K619E | 450 | K645A/K732E |
| 373 | K569D/K625A | 412 | K562D/K619A | 451 | K645D/K732A |
| 374 | K569D/K625D | 413 | K562D/K619D | 452 | K645D/K732D |
| 375 | K569D/K625E | 414 | K562D/K619E | 453 | K645D/K732E |
| 376 | K569E/K625A | 415 | K562E/K619A | 454 | K645E/K732A |
| 377 | K569E/K625D | 416 | K562E/K619D | 455 | K645E/K732D |
| 378 | K569E/K625E | 417 | K562E/K619E | 456 | K645E/K732E |
| 379 | K569A/N573A/K625A | 418 | K562A/N566A/K619A | 457 | K645A/N649A/K732A |
| 380 | K569A/N573D/K625A | 419 | K562A/N566D/K619A | 458 | K645A/N649D/K732A |
| 381 | K569A/N573E/K625A | 420 | K562A/N566E/K619A | 459 | K645A/N649E/K732A |
| 382 | K569A/N573A/K625D | 421 | K562A/N566A/K619D | 460 | K645A/N649A/K732D |
| 383 | K569A/N573D/K625D | 422 | K562A/N566D/K619D | 461 | K645A/N649D/K732D |
| 384 | K569A/N573E/K625D | 423 | K562A/N566E/K619D | 462 | K645A/N649E/K732D |
| 385 | K569A/N573A/K625E | 424 | K562A/N566A/K619E | 463 | K645A/N649A/K732E |
| 386 | K569A/N573D/K625E | 425 | K562A/N566D/K619E | 464 | K645A/N649D/K732E |
| 387 | K569A/N573E/K625E | 426 | K562A/N566E/K619E | 465 | K645A/N649E/K732E |
| 388 | K569D/N573A/K625A | 427 | K562D/N566A/K619A | 466 | K645D/N649A/K732A |
| 389 | K569D/N573D/K625A | 428 | K562D/N566D/K619A | 467 | K645D/N649D/K732A |
| 390 | K569D/N573E/K625A | 429 | K562D/N566E/K619A | 468 | K645D/N649E/K732A |
| 391 | K569D/N573A/K625D | 430 | K562D/N566A/K619D | 469 | K645D/N649A/K732D |
| 392 | K569D/N573D/K625D | 431 | K562D/N566D/K619D | 470 | K645D/N649D/K732D |
| 393 | K569D/N573E/K625D | 432 | K562D/N566E/K619D | 471 | K645D/N649E/K732D |
| 394 | K569D/N573A/K625E | 433 | K562D/N566A/K619E | 472 | K645D/N649A/K732E |
| 395 | K569D/N573D/K625E | 434 | K562D/N566D/K619E | 473 | K645D/N649D/K732E |
| 396 | K569D/N573E/K625E | 435 | K562D/N566E/K619E | 474 | K645D/N649E/K732E |
| 397 | K569E/N573A/K625A | 436 | K562E/N566A/K619A | 475 | K645E/N649A/K732A |
| 398 | K569E/N573D/K625A | 437 | K562E/N566D/K619A | 476 | K645E/N649D/K732A |
| 399 | K569E/N573E/K625A | 438 | K562E/N566E/K619A | 477 | K645E/N649E/K732A |
| 400 | K569E/N573A/K625D | 439 | K562E/N566A/K619D | 478 | K645E/N649A/K732D |
| 401 | K569E/N573D/K625D | 440 | K562E/N566D/K619D | 479 | K645E/N649D/K732D |
| 402 | K569E/N573E/K625D | 441 | K562E/N566E/K619D | 480 | K645E/N649E/K732D |
| 403 | K569E/N573A/K625E | 442 | K562E/N566A/K619E | 481 | K645E/N649A/K732E |
| 404 | K569E/N573D/K625E | 443 | K562E/N566D/K619E | 482 | K645E/N649D/K732E |
| 405 | K569E/N573E/K625E | 444 | K562E/N566E/K619E | 483 | K645E/N649E/K732E |

TABLE 13

Exemplary Variant Ortholog Cas12a's

| SEQ ID NO: | Variant AaCas12a (in relation to wt AaCas12a SEQ ID NO:13) | SEQ ID NO: | Variant BoCas12a (in relation to wt BoCas12a SEQ ID NO:14) | SEQ ID NO: | Variant CMaCas12a (in relation to wt CMaCas12a SEQ ID NO:15) |
|---|---|---|---|---|---|
| 484 | K607A | 523 | K653A | 562 | K577A |
| 485 | K607D | 524 | K653D | 563 | K577D |
| 486 | K607E | 525 | K653E | 564 | K577E |
| 487 | K548A/K607A | 526 | K592A/K653A | 565 | K521A/K577A |
| 488 | K548A/K607D | 527 | K592A/K653D | 566 | K521A/K577D |
| 489 | K548A/K607E | 528 | K592A/K653E | 567 | K521A/K577E |
| 490 | K548D/K607A | 529 | K592D/K653A | 568 | K521D/K577A |
| 491 | K548D/K607D | 530 | K592D/K653D | 569 | K521D/K577D |
| 492 | K548D/K607E | 531 | K592D/K653E | 570 | K521D/K577E |
| 493 | K548E/K607A | 532 | K592E/K653A | 571 | K521E/K577A |
| 494 | K548E/K607D | 533 | K592E/K653D | 572 | K521E/K577D |
| 495 | K548E/K607E | 534 | K592E/K653E | 573 | K521E/K577E |
| 496 | K548A/N552A/K607A | 535 | K592A/N596A/K653A | 574 | K521A/N525A/K577A |
| 497 | K548A/N552D/K607A | 536 | K592A/N596D/K653A | 575 | K521A/N525D/K577A |
| 498 | K548A/N552E/K607A | 537 | K592A/N596E/K653A | 576 | K521A/N525E/K577A |
| 499 | K548A/N552A/K607D | 538 | K592A/N596A/K653D | 577 | K521A/N525A/K577D |
| 500 | K548A/N552D/K607D | 539 | K592A/N596D/K653D | 578 | K521A/N525D/K577D |
| 501 | K548A/N552E/K607D | 540 | K592A/N596E/K653D | 579 | K521A/N525E/K577D |
| 502 | K548A/N552A/K607E | 541 | K592A/N596A/K653E | 580 | K521A/N525A/K577E |
| 503 | K548A/N552D/K607E | 542 | K592A/N596D/K653E | 581 | K521A/N525D/K577E |

TABLE 13-continued

Exemplary Variant Ortholog Cas12a's

| SEQ ID NO: | Variant AaCas12a (in relation to wt AaCas12a SEQ ID NO:13) | SEQ ID NO: | Variant BoCas12a (in relation to wt BoCas12a SEQ ID NO:14) | SEQ ID NO: | Variant CMaCas12a (in relation to wt CMaCas12a SEQ ID NO:15) |
|---|---|---|---|---|---|
| 504 | K548A/N552E/K607E | 543 | K592A/N596E/K653E | 582 | K521A/N525E/K577E |
| 505 | K548D/N552A/K607A | 544 | K592D/N596A/K653A | 583 | K521D/N525A/K577A |
| 506 | K548D/N552D/K607A | 545 | K592D/N596D/K653A | 584 | K521D/N525D/K577A |
| 507 | K548D/N552E/K607A | 546 | K592D/N596E/K653A | 585 | K521D/N525E/K577A |
| 508 | K548D/N552A/K607D | 547 | K592D/N596A/K653D | 586 | K521D/N525A/K577D |
| 509 | K548D/N552D/K607D | 548 | K592D/N596D/K653D | 587 | K521D/N525D/K577D |
| 510 | K548D/N552E/K607D | 549 | K592D/N596E/K653D | 588 | K521D/N525E/K577D |
| 511 | K548D/N552A/K607E | 550 | K592D/N596A/K653E | 589 | K521D/N525A/K577E |
| 512 | K548D/N552D/K607E | 551 | K592D/N596D/K653E | 590 | K521D/N525D/K577E |
| 513 | K548D/N552E/K607E | 552 | K592D/N596E/K653E | 591 | K521D/N525E/K577E |
| 514 | K548E/N552A/K607A | 553 | K592E/N596A/K653A | 592 | K521E/N525A/K577A |
| 515 | K548E/N552D/K607A | 554 | K592E/N596D/K653A | 593 | K521E/N525D/K577A |
| 516 | K548E/N552E/K607A | 555 | K592E/N596E/K653A | 594 | K521E/N525E/K577A |
| 517 | K548E/N552A/K607D | 556 | K592E/N596A/K653D | 595 | K521E/N525A/K577D |
| 518 | K548E/N552D/K607D | 557 | K592E/N596D/K653D | 596 | K521E/N525D/K577D |
| 519 | K548E/N552E/K607D | 558 | K592E/N596E/K653D | 597 | K521E/N525E/K577D |
| 520 | K548E/N552A/K607E | 559 | K592E/N596A/K653E | 598 | K521E/N525A/K577E |
| 521 | K548E/N552D/K607E | 560 | K592E/N596D/K653E | 599 | K521E/N525D/K577E |
| 522 | K548E/N552E/K607E | 561 | K592E/N596E/K653E | 600 | K521E/N525E/K577E |

In some embodiments, the single-strand-specific Cas12a nucleic acid-guided nuclease is at least 70% identical to any one of SEQ ID NOs: 16-600. In some embodiments, the single-strand-specific Cas12a nucleic acid-guided nuclease is at least 75% identical to any one of SEQ ID NOs: 16-600 16-600. In some embodiments, the single-strand-specific Cas12a nucleic acid-guided nuclease is at least 80% identical to any one of SEQ ID NOs: 16-600. In some embodiments, the single-strand-specific Cas12a nucleic acid-guided nuclease is at least 85% identical to any one of SEQ ID NOs: 16-600. In some embodiments, the single-strand-specific Cas12a nucleic acid-guided nuclease is at least 90% identical to any one of SEQ ID NOs: 16-600. In some embodiments, the single-strand-specific Cas12a nucleic acid-guided nuclease is at least 95% identical to any one of SEQ ID NOs: 16-600. In some embodiments, the single-strand-specific Cas12a nucleic acid-guided nuclease is at least 96%, 97%, 98% or 99% identical to any one of SEQ ID NOs: 16-600. In some embodiments, the single-strand-specific Cas12a nucleic acid-guided nuclease is any one of SEQ ID NOs: 16-600.

The mutations described herein are described in the context of the WT LbCas12a (e.g., SEQ ID NO: 1) sequence and mutational positions can be carried out by aligning the amino acid sequence of a Cas12a nucleic acid-guided nuclease with SEQ ID NO: 1 and making the equivalent modification (e.g., substitution) at the equivalent position. By way of example, the mutations described herein may be applied to a Cas12a enzyme shown in Table 7, or any other homolog Cas12a thereof by aligning the amino acid sequence of the Cas12a to SEQ ID NO: 1 and making the modifications described in Tables 9-13 (changes to the wildtype residue to alanine, aspartic acid or glutamic acid or conservative equivalents at the Cas12a ortholog's equivalent position (e.g., see Table 8 for an example of equivalent residue positions).

For example, in addition to the variant LbCas12a sequences in Table 9 (variant sequences SEQ ID Nos: 16-54), like variants are envisioned for AsCas12a (variant sequences SEQ ID Nos: 55-93), CtCas12a (variant sequences SEQ ID Nos: 94-132), EeCas12a (variant sequences SEQ ID Nos: 133-171), Mb3Cas12a (variant sequences SEQ ID Nos: 172-210), FnCas12a (variant sequences SEQ ID Nos: 211-249), FnoCas12a (variant sequences SEQ ID Nos: 250-288), FbCas12a (variant sequences SEQ ID Nos: 289-327), Lb4Cas12a (variant sequences SEQ ID Nos: 328-366), MbCas12a (variant sequences SEQ ID Nos: 367-405), Pb2Cas12a (variant sequences SEQ ID Nos: 406-444), PgCas12a (variant sequences SEQ ID Nos: 445-483), AaCas12a (variant sequences SEQ ID Nos: 484-522), BoCas12a (variant sequences SEQ ID Nos: 523-561), and CmaCas12a (variant sequences SEQ ID Nos: 562-600). In some embodiments, the single-strand-specific Cas12a nucleic acid-guided nuclease is at least 70% identical to any one of SEQ ID NOs: 16-600 and contains an amino acid substitution(s) listed in Tables 9-13 or the equivalent in a different ortholog. In some embodiments, the single-strand-specific Cas12a nucleic acid-guided nuclease is at least 75% identical to any one of SEQ ID NOs: 16-600 and contains an amino acid substitution(s) listed in Tables 9-13 or the equivalent in a different ortholog. In some embodiments, the single-strand-specific Cas12a nucleic acid-guided nuclease is at least 80% identical to any one of SEQ ID NOs: 16-600 and contains an amino acid substitution(s) listed in Tables 9-13 or the equivalent in a different ortholog. In some embodiments, the single-strand-specific Cas12a nucleic acid-guided nuclease is at least 85% identical to any one of SEQ ID NOs: 16-600 and contains an amino acid substitution(s) listed in Tables 9-13 or the equivalent in a different ortholog. In some embodiments, the single-strand-specific Cas12a nucleic acid-guided nuclease is at least 90% identical to any one of SEQ ID NOs: 16-600 and contains an amino acid substitution(s) listed in Tables 9-13 or the equivalent in a different ortholog. In some embodiments, the single-strand-specific Cas12a nucleic acid-guided nuclease is at least 95% identical to any one of SEQ ID NOs: 16-600 and contains an amino acid substitution(s) listed in Tables 9-13 or the equivalent in a different ortholog. In some embodiments, the single-strand-specific Cas12a nucleic acid-guided nuclease is at least %, 97%, 98% or 99% identical to any one of SEQ ID NOs: 16-600 and contains an amino acid substitution(s) listed in Tables 9-13 or the equivalent in a different ortholog.

In some embodiments, the single-strand-specific Cas12a nucleic acid-guided nuclease is any one of SEQ ID NOs: 16-600.

The single-strand-specific Cas12a nucleic acid-guided nucleases described herein may be any Cas12a nucleic acid-guided nuclease that largely prevents double-stranded nucleic acid unwinding and R-loop formation. The single-strand-specific Cas12a nucleic acid-guided nucleases described herein may also be any Cas12a nucleic acid-guided nuclease that lacks cis-cleavage activity yet maintains trans-nucleic acid-guided nuclease activity on single-stranded nucleic acid molecules. Such single-strand-specific Cas12a nucleic acid-guided nucleases may be generated via the mutations described herein.

Additionally, or alternatively, such single-strand-specific Cas12a nucleic acid-guided nucleases may be generated via post-translational modifications (e.g., acetylation). The single-strand-specific Cas12a nucleic acid-guided nucleases of the disclosure may be an acetylated Cas12a enzyme. The single-strand-specific Cas12a nucleic acid-guided nucleases of the disclosure may be an LbCas12a (i.e., SEQ ID NO: 1) with an acetylated K595 ($K595K^{Ac}$) residue. The single-strand-specific Cas12a nucleic acid-guided nucleases of the disclosure may be an AsCas12a (i.e., SEQ ID NO: 2) with an acetylated K607 ($K607K^{Ac}$) residue. The single-strand-specific Cas12a nucleic acid-guided nucleases of the disclosure may be a CtCas12a (i.e., SEQ ID NO: 3) with an acetylated R591 ($R591R^{Ac}$) residue. The single-strand-specific Cas12a nucleic acid-guided nucleases of the disclosure may be an EeCas12a (i.e., SEQ ID NO: 4) with an acetylated K601 ($K607K^{Ac}$) residue. The single-strand-specific Cas12a nucleic acid-guided nucleases of the disclosure may be an Mb3Cas12a (i.e., SEQ ID NO: 5) with an acetylated K635 ($K635K^{Ac}$) residue. The single-strand-specific Cas12a nucleic acid-guided nucleases of the disclosure may be an FnCas12a (i.e., SEQ ID NO: 6) with an acetylated K671 ($K671K^{Ac}$) residue. The single-strand-specific Cas12a nucleic acid-guided nucleases of the disclosure may be an FnoCas12a (i.e., SEQ ID NO: 7) with an acetylated N671 ($N671K^{Ac}$) residue. The single-strand-specific Cas12a nucleic acid-guided nucleases of the disclosure may be an FbCas12a (i.e., SEQ ID NO: 8) with an acetylated K678 ($K678K^{Ac}$) residue. The single-strand-specific Cas12a nucleic acid-guided nucleases of the disclosure may be an Lb4Cas12a (i.e., SEQ ID NO: 9) with an acetylated K601 ($K601K^{Ac}$) residue. The single-strand-specific Cas12a nucleic acid-guided nucleases of the disclosure may be an MbCas12a (i.e., SEQ ID NO: 10) with an acetylated K625 ($K625K^{Ac}$) residue. The single-strand-specific Cas12a nucleic acid-guided nucleases of the disclosure may be a Pb2Cas12a (i.e., SEQ ID NO: 11) with an acetylated K619 ($K619K^{Ac}$) residue. The single-strand-specific Cas12a nucleic acid-guided nucleases of the disclosure may be a PgCas12a (i.e., SEQ ID NO: 12) with an acetylated K732 ($K732K^{Ac}$) residue. The single-strand-specific Cas12a nucleic acid-guided nucleases of the disclosure may be an AaCas12a (i.e., SEQ ID NO: 13) with an acetylated K607 ($K607K^{Ac}$) residue. The single-strand-specific Cas12a nucleic acid-guided nucleases of the disclosure may be an BoCas12a (i.e., SEQ ID NO: 14) with an acetylated K653 ($K653K^{Ac}$) residue. The single-strand-specific Cas12a nucleic acid-guided nucleases of the disclosure may be an CmaCas12a (i.e., SEQ ID NO: 15) with an acetylated K577 ($K577K^{Ac}$) residue. The single-strand-specific Cas12a nucleic acid-guided nucleases of the disclosure may be a Cas12a ortholog acetylated at the amino acid of the ortholog equivalent to K595 of SEQ ID NO:1. Acetylation of Cas12a can be carried out with any suitable acetyltransferase. For a discussion and methods for disabling of Cas12a by ArVA5, see Dong, et al., Nature Structural and Molecular Bio., 26(4):308-14 (2019). For example, LbCas12a can be incubated with AcrVA5 in order to acetylate the K595 residue, thereby deactivating the dsDNA activity (e.g., FIG. 7). In addition to acetylation, phosphorylation and methylation of select amino acid residues may be employed.

Bulky Modifications

In addition to the modalities of adjusting the ratio of the concentration of the blocked nucleic acid molecules to the concentration of the RNP2 and altering the domains of the variant nucleic acid-guided nuclease of RNP2 that interact with the PAM region or surrounding sequences on the blocked nucleic acid molecules to vary dsDNA vs. ssDNA recognition properties as described in detail above, the present disclosure additionally contemplates use of "bulky modifications" at the 5' and/or 3' ends and/or at internal nucleic acid bases of the blocked nucleic acid molecule and/or using modifications between internal nucleic acid bases. FIG. 8A is an illustration of the steric hindrance at the PAM-interacting (PI) domain in a nucleic acid-guided nuclease caused by 5' and 3' modifications to a blocked nucleic acid molecule. At top in FIG. 8A is an illustration of the target stand and non-target strand, and below this is an illustration of a self-hybridized blocked nucleic acid molecule comprising three loop regions, as well as bulky modifications on the 5' and 3' ends of the blocked nucleic acid molecule. Example "bulky modifications" include a fluorophore and quencher pair (as shown here) or biotin, but in general encompass molecules with a size of about 1 nm or less, or 0.9 nm or less, or 0.8 nm or less, or 0.7 nm or less, or 0.6 nm or less, or 0.5 nm or less, or 0.4 nm or less, or 0.3 nm or less, or 0.2 nm or less, or 0.1 nm or less, or 0.05 nm or less, or as small as 0.025 nm or less.

In the illustration at center, the blocked nucleic acid molecule with the 5' and 3' ends comprising a fluorophore and a quencher is shown being cleaved at the loop regions. Note that the bulky modifications in this embodiment also allow the blocked nucleic acid molecule to act as a reporter moiety; that is, when the loop regions of the blocked nucleic acid molecule are cleaved, the short nucleotide segments of the non-target strand dehybridize from the target strand due to low $T_m$, thereby separating the fluorophore and quencher such that fluorescence from the fluorophore is no longer quenched and can be detected. In the illustration at bottom, the intact blocked nucleic acid molecule with the bulky modifications (at left) sterically hinders interaction with the PAM-interacting (PI) domain of the nucleic acid-guided nuclease in RNP2 such that the intact blocked nucleic acid molecule cannot be cleaved via cis-cleavage by the nucleic acid-guided nuclease. However, once the loop regions of the blocked nucleic acid molecule are cleaved (via, e.g., trans-cleavage from RNP1 (at right)) and the short nucleotide segments of the non-target strand dehybridize from the target strand, leaving the 3' end of the now single-stranded target strand is now free to initiate R-loop formation with RNP2. R-loop formation leads to cis-cleavage of the single-strand target strand, and subsequent activation of trans-cleavage of RNP2.

Figure 8B:
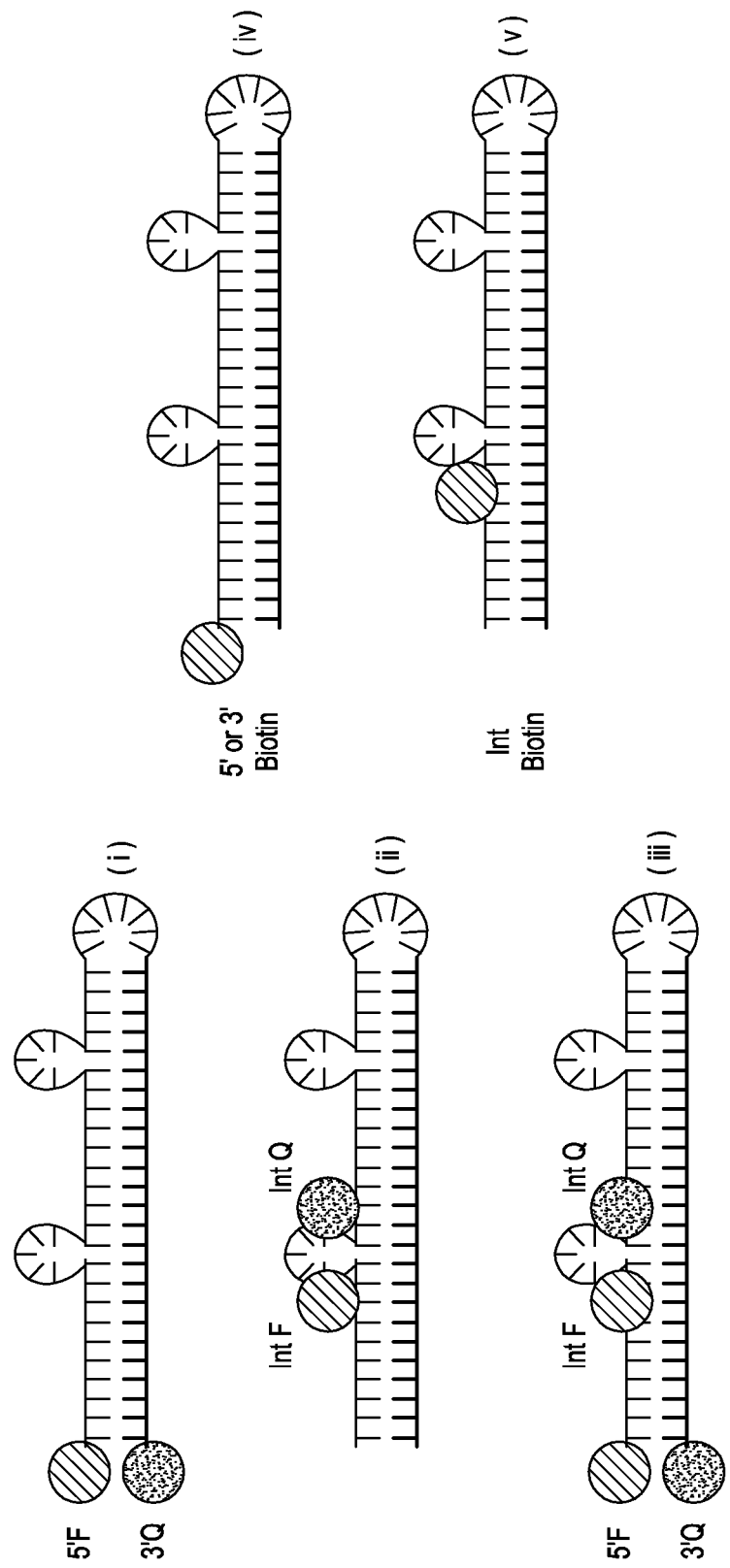
FIG. 8B illustrates five exemplary variations of blocked nucleic acid molecules with bulky modifications.

FIG. 8B illustrates five exemplary variations of blocked nucleic acid molecules with bulky modifications, including at the 5' and/or 3' ends of a self-hybridizing blocked nucleic acid molecule and/or at internal nucleic acid bases of the blocked nucleic acid molecule. Embodiment (i) illustrates a self-hybridizing blocked nucleic acid molecule having a fluorophore at its 5' end and a quencher at its 3' end.

Embodiment (ii) illustrates a self-hybridizing blocked nucleic acid molecule having a fluorophore and a quencher at internal nucleic acid bases flanking a loop sequence. Embodiment (iii) illustrates a self-hybridizing blocked nucleic acid molecule having a fluorophore at its 5' end and a quencher at its 3' end as well as having a fluorophore and a quencher at internal nucleic acid bases where the internal fluorophore and quencher flank a loop sequence. The fluorophore/quencher embodiments work as long as the fluorophore and quencher are at a distance of about 10-11 nm or less apart. Embodiment (iv) illustrates a self-hybridizing blocked nucleic acid molecule having a biotin molecule at its 5' end, and embodiment (v) illustrates a self-hybridizing blocked nucleic acid molecule having a biotin at an internal nucleic acid base. Note that bulky modifications of internal nucleic acid bases often are made at or near a loop region of a blocked nucleic acid molecule (or blocked target molecule). The loop regions are regions of the blocked nucleic acid molecules—in addition to the 5' and 3' ends—that may be vulnerable to unwinding.

Modifications can be used in self-hybridized blocked nucleic acid molecules lacking a PAM or those comprising a PAM, partially self-hybridized blocked nucleic acid molecules lacking a PAM or those comprising a PAM, or reverse PAM molecules. Other variations include using RNA loops instead of DNA loops if a Cas 13 nucleic acid-guided nuclease is used as the nucleic acid-guided nuclease in RNP1, or entire RNA molecules if a Cas 13 nucleic acid-guided nuclease is used as the nucleic acid-guided nuclease in RNP1 and RNP2.

FIGS. 8C, 8D and 8E list exemplary bulky modifications for 5', 3', and internal positions in blocked nucleic acid molecules, and Table 14 below lists sequences of exemplary self-hybridizing blocked nucleic acid molecules. 56-FAM stands for 5' 6-FAM (6-fluorescein amidite); and 3BHQ stands for 3' BLACK HOLE QUENCHER®-1.

TABLE 14

Bulky Modifications

| No. | SEQ ID NO: | Molecule Name | Molecule Sequence (5'→3') |
|---|---|---|---|
| 5' FAM + 3' BHQ ||||
| 1 | 601 | 5'F_U29_Q | /56-FAM/GATCCATTTTATTTTAGATCATATATATACATGATCGGATC/3BHQ_1/ |
| 2 | 602 | 5'F_1C armor_U29_Q | /56-FAM/CGATCCATTTTATTTTAGATCATATATATACATGATCGGATCG/3BHQ_1/ |
| 3 | 603 | 5'F_2CC armor_U29_Q | /56-FAM/CCGATCCATTTTATTTTAGATCATATATATACATGATCGGATCGG/3BHQ_1/ |
| 4 | 604 | 5'F_1A armor_U29_Q | /56-FAM/AGATCCATTTTATTTTAGATCATATATATACATGATCGGATCT/3BHQ_1/ |
| 5 | 605 | 5'F_2AT armor_U29_Q | /56-FAM/ATGATCCATTTTATTTTAGATCATATATATACATGATCGGATCAT/3BHQ_1/ |
| 6 | 606 | 5'F_U250_Q | /56-FAM/GATATATAAAAAAAAAAAGATCATATACATATATGATCATATATC/3BHQ_1/ |
| 7 | 607 | 5'F_1C armor_U250_Q | /56-FAM/CGATATATAAAAAAAAAAAGATCATATACATATATGATCATATATCG/3BHQ_1/ |
| 8 | 608 | 5'F_2CC armor_U250_Q | /56-FAM/CCGATATATAAAAAAAAAAAGATCATATACATATATGATCATATATCGG/3BHQ_1/ |
| 9 | 609 | 5'F_1A armor_U250_Q | /56-FAM/AGATATATAAAAAAAAAAAGATCATATACATATATGATCATATATCT/3BHQ_1/ |
| 10 | 610 | 5'F_2AT armor_U250_Q | /56-FAM/ATGATATATAAAAAAAAAAAGATCATATACATATATGATCATATATCAT/3BHQ_1/ |
| 5' Fluorsceine (modification on base) + 3' BHQ ||||
| 11 | 611 | 5'FdT_U29_Q | /5FluorT/GATCCATTTTATTTTAGATCATATATATACATGATCGGATCA/3BHQ_1/ |
| 12 | 612 | 5'FdT_1C armor_U29_Q | /5FluorT/CGATCCATTTTATTTTAGATCATATATATACATGATCGGATCGA/3BHQ_1/ |

TABLE 14-continued

Bulky Modifications

| No. | SEQ ID NO: | Molecule Name | Molecule Sequence (5'→3') |
|---|---|---|---|
| 13 | 605 | 5'FdT_1A armor_U29_Q | A/iFluorT/GATCCATTTTATTTTAGATCATATATATACATGAT CGGATCAT/3BHQ_1/ |
| 14 | 613 | 5'FdT_U250_Q | /5FluorT/GATATATAAAAAAAAAAAGATCATATACATATATG ATCATATATCA/3BHQ_1/ |
| 15 | 614 | 5'FdT_1C armor_U250_Q | /5FluorT/CGATATATAAAAAAAAAAAGATCATATACATATAT GATCATATATCGA/3BHQ_1/ |
| 16 | 610 | 5'FdT_1A armor_U250_Q | A/iFluorT/GATATATAAAAAAAAAAAGATCATATACATATAT GATCATATATCAT/3BHQ_1/ |

5' FAM + Internal Fluorsceine (modification on base) + 3' BHQ

| No. | SEQ ID NO: | Molecule Name | Molecule Sequence (5'→3') |
|---|---|---|---|
| 17 | 601 | 5'F_IntFdt_U29_Q | /56-FAM/GA/iFluorT/CCATTTTATTTTAGATCATATATATACATG ATCGGATC/3BHQ_1/ |
| 18 | 606 | 5'F_IntFdt_U250_Q | /56-FAM/GA/iFluorT/ATATAAAAAAAAAAAGATCATATACATAT ATGATCATATATC/3BHQ_1/ |
| 19 | 602 | 5'F_1C armor_IntFdt_U29_Q | /56-FAM/CGA/iFluorT/CCATTTTATTTTAGATCATATATATACAT GATCGGATCG/3BHQ_1/ |
| 20 | 604 | 5'F_1A armor_IntFdt_U29_Q | /56-FAM/AGA/iFluorT/CCATTTTATTTTAGATCATATATATACAT GATCGGATCT/3BHQ_1/ |
| 21 | 607 | 5'F_1C armor_IntFdt_U250_Q | /56-FAM/CGA/iFluorT/ATATAAAAAAAAAAAGATCATATACATA TATGATCATATATCG/3BHQ_1/ |
| 22 | 609 | 5'F_1A armor_IntFdt_U250_Q | /56-FAM/AGA/iFluorT/ATATAAAAAAAAAAAGATCATATACATA TATGATCATATATCT/3BHQ_1/ |
| 23 | 603 | 5'F_2CC armor_IntFdt_U29_Q | /56-FAM/CCGA/iFluorT/CCATTTTATTTTAGATCATATATATACA TGATCGGATCGG/3BHQ_1/ |
| 24 | 605 | 5'F_2AT armor_IntFdt_U29_Q | /56-FAM/ATGA/iFluorT/CCATTTTATTTTAGATCATATATATACA TGATCGGATCAT/3BHQ_1/ |
| 25 | 608 | 5'F_2CC armor_IntFdt_U250_Q | /56-FAM/CCGA/iFluorT/ATATAAAAAAAAAAAGATCATATACAT ATATGATCATATATCGG/3BHQ_1/ |
| 26 | 610 | 5'F_2AT armor_IntFdt_U250_Q | /56-FAM/ATGA/iFluorT/ATATAAAAAAAAAAAGATCATATACAT ATATGATCATATATCAT/3BHQ_1/ |

Applications of the Cascade Assay

The present disclosure describes cascade assays for detecting a target nucleic acid of interest in a sample that provide instantaneous or nearly instantaneous results even at ambient temperatures at 16° C. and above, allow for massive multiplexing and minimum workflow, yet provide accurate results at low cost. Moreover, the various embodiments of the cascade assay are notable in that, with the exception of the gRNA in RNP1, the cascade assay components stay the same no matter what target nucleic acid(s) of interest are being detected and RNP1 is easily reprogrammed. Moreover, the cascade assay can be massively multiplexed for detecting several to many to target nucleic acid molecules simultaneously. For example, the assay may be designed to detect one to several to many different pathogens (e.g., testing for many different pathogens in one assay), or the assay may be designed to detect one to several to many different sequences from the same pathogen (e.g., to increase specificity and sensitivity), or a combination of the two.

As described above, early and accurate identification of, e.g., infectious agents, microbe contamination, and variant nucleic acid sequences that indicate the present of such diseases such as cancer or contamination by heterologous sources is important in order to select correct therapeutic treatment, identify tainted food, pharmaceuticals, cosmetics and other commercial goods; and to monitor the environment. The cascade assay described herein can be applied in diagnostics for, e.g., infectious disease (including but not limited to Covid, HIV, flu, the common cold, Lyme disease, STDs, chicken pox, diptheria, mononucleosis, hepatitis, UTIs, pneumonia, tetanus, rabies, malaria, dengue fever, Ebola, plague; see Table 1), for rapid liquid biopsies and companion diagnostics (biomarkers for cancers, early detection, progression, monitoring; see Table 4), prenatal testing (including but not limited to chromosomal abnormalities and genetic diseases such as sickle cell, including over-the-counter versions of prenatal testing assays), rare disease testing (achondroplasia, Addison's disease, a1-antitrypsin deficiency, multiple sclerosis, muscular dystrophy, cystic fibrosis, blood factor deficiencies), SNP detection/DNA profiling/epigenetics, genotyping, low abundance transcript detection, labeling for cell or droplet sorting, in situ nucleic acid detection, sample prep, library quantification of NGS, screening biologics (including engineered therapeutic cells for genetic integrity and/or contamination), development of agricultural products, food compliance testing and quality control (e.g., detection of genetically modified products, confirmation of source for high value commodities, contamination detection), infectious disease in livestock, infectious disease in cash crops, livestock breeding, drug screening, personal genome testing including clinical trial stratification, personalized medicine, nutrigenomics, drug development and drug therapy efficacy, transplant compatibility and monitoring, environmental testing and forensics, and bioterrorism agent monitoring.

Target nucleic acids of interest are derived from samples as described in more detail above. Suitable samples for testing include, but are not limited to, any environmental sample, such as air, water, soil, surface, food, clinical sites and products, industrial sites and products, pharmaceuticals, medical devices, nutraceuticals, cosmetics, personal care products, agricultural equipment and sites, and commercial samples, and any biological sample obtained from an organism or a part thereof, such as a plant, animal, or microbe. In some embodiments, the biological sample is obtained from an animal subject, such as a human subject. A biological sample may be any solid or fluid sample obtained from, excreted by or secreted by any living organism, including, without limitation, single celled organisms, such as bacteria, yeast, protozoans, and amoebas among others, multicellular organisms including plants or animals, including samples from a healthy or apparently healthy human subject or a human patient affected by a condition or disease to be diagnosed or investigated, such as an infection with a pathogenic microorganism, such as a pathogenic bacteria or virus.

For example, a biological sample can be a biological fluid obtained from a human or non-human (e.g., livestock, pets, wildlife) animal, and may include but is not limited to blood, plasma, serum, urine, stool, sputum, mucous, lymph fluid, synovial fluid, bile, ascites, pleural effusion, seroma, saliva, cerebrospinal fluid, aqueous or vitreous humor, or any bodily secretion, a transudate, an exudate (for example, fluid obtained from an abscess or any other site of infection or inflammation), or fluid obtained from a joint (for example, a normal joint or a joint affected by disease, such as rheumatoid arthritis, osteoarthritis, gout or septic arthritis), or a swab of skin or mucosal membrane surface (e.g., a nasal or buccal swab).

In some embodiments, the sample can be a viral or bacterial sample or a biological sample that has been minimally processed, e.g., only treated with a brief lysis step prior to detection. In other embodiments, minimal processing can include thermal lysis at an elevated temperature to release nucleic acids. Suitable methods are contemplated in U.S. Pat. No. 9,493,736, among other references. Common methods for cell lysis involve thermal, chemical, enzymatic, or mechanical treatment of the sample or a combination of those (see, e.g., Example I below). In some embodiments, minimal processing can include treating the sample with chaotropic salts such as guanidine isothiocyanate or guanidine HCl. Suitable methods are contemplated in U.S. Pat. Nos. 8,809,519 and 7,893,251, among other references. In some embodiments, minimal processing may include contacting the sample with reducing agents such as DTT or TCEP and EDTA to inactivate inhibitors and/or other nucleases present in the crude samples. In other embodiments, minimal processing for biofluids may include centrifuging the samples to obtain cell-debris free supernatant before applying the reagents. Suitable methods are contemplated in U.S. Pat. No. 8,809,519, among other references. In still other embodiments, minimal processing may include performing DNA/RNA extraction to get purified nucleic acids before applying CRISPR Cascade reagents.

Table 15 below lists exemplary commercial sample processing kits, and Table 16 below lists point of care processing techniques.

TABLE 15

Exemplary Commercial Sample and Nucleic Acid Processing Kits

| Manufacturer | Kit | Sample Type | Output | Lysing and extraction methods |
|---|---|---|---|---|
| Qiagen ® | DNeasy ™ Blood & Tissue Kits | small volumes of blood dried blood spots urine tissues laser-microdissected tissues | genomic DNA | Isolation of Genomic DNA from Small Volumes of Blood<br>1. Uses Chemical and Biological/Enzymatic lysis methods<br>2. Uses SPE with Column Purification<br>Isolation of Genomic DNA from Tissues<br>1. Uses Chemical and Biological/Enzymatic lysis methods<br>2. Used to dissolve and lyse tissue sections completely, higher temperature and longer time incubations up to 24 hours are used |
| Qiagen ® | QIAamp ® UCP Pathogen Mini Handbook microbial DNA purification | whole blood swabs cultures -- pelleted microbial cells body fluids | microbial DNA | Specific pretreatment protocols are suggested depending on sample type with or without the use of kits for Mechanical Lysis Method before downstream applications.<br>Downstream applications contain:<br>1. Chemical and Biological/Enzymatic lysis methods<br>2. SPE with Column Purification |

TABLE 15-continued

Exemplary Commercial Sample and Nucleic Acid Processing Kits

| Manufacturer | Kit | Sample Type | Output | Lysing and extraction methods |
|---|---|---|---|---|
| Qiagen ® | QIAamp ® Viral RNA Kits | plasma and serum CSF urine other cell-free body fluids cell-culture supernatants swabs | viral DNA | 1. Uses Chemical lysis methods 2. Uses SPE with Column Purification |
| Zymo Research ™ | Quick-DNA ™ Microprep Kit | whole blood plasma serum body fluids buffy coat lymphocytes swabs cultured cells | genomic DNA | 1. Uses chemical lysis methods 2. Uses SPE with column purification |
| Zymo Research ™ | Quick-DNA ™ Fungal/Bacterial Miniprep Kit | *A. fumigatus* *C. albicans* *N. crassa* *S. cerevisiae* *S. pombe* mycelium Gram positive bacteria Gram negative bacteria | Microbial DNA | Uses Bead lysis and pretreatment with: 1. Chemical lysis methods with chaotropic salts 2. NAE with SPE with silica matrices |

TABLE 16

Point of Care Sample Processing Techniques

| Steps | Protocol Example 1 | Protocol Example 2 | Protocol Example 3 |
|---|---|---|---|
| | Field-deployable viral diagnostics using CRISPR-Cas13 Science, 27; 360(6387):444-448 (2018) | Streamlined inactivation, amplification, and Cas13-based detection of SARS-COV-2 Nat Commun, 11: 5921 (2020) | Lucira Health ™ |
| 1. Cell disruption (lysis) and inactivation of nucleases In POC setting, cell disruption and inactivation of nucleases is done commonly through thermal lysis. | Samples were thermally treated at ~40° C. for ~15 minutes for nuclease deactivation, thereafter at 90° C. for 5 minutes for viral deactivation. Sample Types: Urine Saliva Diluted blood (1:3 with PBS) Targets: Viruses | A NP swab or saliva sample was lysed and inactivated for 10 minutes with thermal treatment. These samples were incubated for 5 min at 40° C., followed by 5 min at 70° C. (or 5 min at 95° C., if saliva) | Lucira Health uses a single buffer that lyses and inactivates nucleases and/or inhibitors. A nasal swab is directly added to a single lysing/reaction buffer and vigorously stirred to release the viral particulates from the swab. Target: SARS-Cov-2 |
| 2. Assay on crude sample This is usually a direct assay on the crude sample post cell disruption and inactivation of nucleases. No extraction is usually performed. | Thermally treated biological samples(above) were used directly for amplification and detection of pathogenic nucleic acid. | Thermally treated biological samples(above) were used directly for amplification and detection of pathogenic nucleic acid. | Processed biological sample is used in an isothermal reaction for pathogenic nucleic acid detection. |

FIG. 9 shows a lateral flow assay (LFA) device that can be used to detect the cleavage and separation of a signal from a reporter moiety. For example, the reporter moiety may be a single-stranded or double-stranded oligonucleotide with terminal biotin and fluorescein amidite (FAM) modifications; and, as described above, the reporter moiety may also be part of a blocked nucleic acid. The LFA device may include a pad with binding particles, such as gold nanoparticles functionalized with anti-FAM antibodies; a control line with a first binding moiety attached, such as avidin or streptavidin; a test line with a second binding moiety attached, such as antibodies; and an absorption pad. After completion of a cascade assay (see FIGS. 2A, 3A, and 3B), the assay reaction mix is added to the pad containing the binding particles, (e.g., antibody labeled gold nanoparticles). When the target nucleic acid of interest is present, a reporter moiety is cleaved, and when the target nucleic acid of interest is absent, the reporter is not cleaved.

A moiety on the reporter binds to the binding particles and is transported to the control line. When the target nucleic acid of interest is absent, the reporter moiety is not cleaved, and the first binding moiety binds to the reporter moiety, with the binding particles attached. When the target nucleic acid of interest is present, one portion of the cleaved reporter moiety binds to the first binding moiety, and another portion of the cleaved reporter moiety bound to the binding particles via the moiety binds to the second binding moiety. In one example, anti-FAM gold nanoparticles bind to a FAM terminus of a reporter moiety and flow sequentially toward the control line and then to the test line. For reporters that are not trans-cleaved, gold nanoparticles attach to the control line via biotin-streptavidin and result in a dark control line. In a negative test, since the reporter has not been cleaved, all gold conjugates are trapped on control line due to attachment via biotin-streptavidin. A negative test will result in a dark control line with a blank test line. In a positive test, reporter moieties have been trans-cleaved by the cascade assay, thereby separating the biotin terminus from the FAM terminus. For cleaved reporter moieties, nanoparticles are captured at the test line due to anti-FAM antibodies. This positive test results in a dark test line in addition to a dark control line.

The components of the cascade assay may be provided in various kits for testing at, e.g., point of care facilities, in the field, pandemic testing sites, and the like. In one aspect, the kit for detecting a target nucleic acid of interest in a sample includes: first ribonucleoprotein complexes (RNP1s), second ribonucleoprotein complexes (RNP2s), blocked nucleic acid molecules, and reporter moieties. The first complex (RNP1) comprises a first nucleic acid-guided nuclease and a first gRNA, where the first gRNA includes a sequence complementary to the target nucleic acid(s) of interest. Binding of the first complex (RNP1) to the target nucleic acid(s) of interest activates trans-cleavage activity of the first nucleic acid-guided nuclease. The second complex (RNP2) comprises a second nucleic acid-guided nuclease and a second gRNA that is not complementary to the target nucleic acid of interest. The blocked nucleic acid molecule comprises a sequence complementary to the second gRNA, where trans-cleavage of the blocked nucleic acid molecule results in an unblocked nucleic acid molecule and the unblocked nucleic acid molecule can bind to the second complex (RNP2), thereby activating the trans-cleavage activity of the second nucleic acid-guided nuclease. Activating trans-cleavage activity in RNP2 results in an exponential increase in unblocked nucleic acid molecules and in active reporter moieties, where reporter moieties are nucleic acid molecules and/or are operably linked to the blocked nucleic acid molecules and produce a detectable signal upon cleavage by RNP2.

In a second aspect, the kit for detecting a target nucleic acid molecule in sample includes: first ribonucleoprotein complexes (RNP1s), second ribonucleoprotein complexes (RNP2s), template molecules, blocked primer molecules, a polymerase, NTPs, and reporter moieties. The first ribonucleoprotein complex (RNP1) comprises a first nucleic acid-guided nuclease and a first gRNA, where the first gRNA includes a sequence complementary to the target nucleic acid of interest and where binding of RNP1 to the target nucleic acid(s) of interest activates trans-cleavage activity of the first nucleic acid-guided nuclease. The second complex (RNP2) comprises a second nucleic acid-guided nuclease and a second gRNA that is not complementary to the target nucleic acid of interest. The template molecules comprise a primer binding domain (PBD) sequence as well as a sequence corresponding to a spacer sequence of the second gRNA. The blocked primer molecules comprise a sequence that is complementary to the PBD on the template nucleic acid molecule and a blocking moiety.

Upon binding to the target nucleic acid of interest, RNP1 becomes active triggering trans-cleavage activity that cuts at least one of the blocked primer molecules to produce at least one unblocked primer molecule. The unblocked primer molecule hybridizes to the PBD of one of the template nucleic acid molecules, is trimmed of excess nucleotides by the 3'-to-5' exonuclease activity of the polymerase and is then extended by the polymerase and NTPs to form a synthesized activating molecule with a sequence that is complementary to the second gRNA of RNP2 (i.e., the synthesized activating molecule is the target strand). Upon activating RNP2, additional trans-cleavage activity is initiated, cleaving at least one additional blocked primer molecule. Continued cleavage of blocked primer molecules and subsequent activation of more RNP2s proceeds at an exponential rate. A signal is generated upon cleavage of a reporter molecule by active RNP2 complexes; therefore, a change in signal production indicates the presence of the target nucleic acid molecule.

Any of the kits described herein may further include a sample collection device, e.g., a syringe, lancet, nasal swab, or buccal swab for collecting a biological sample from a subject, and/or a sample preparation reagent, e.g., a lysis reagent. Each component of the kit may be in separate container or two or more components may be in the same container. The kit may further include a lateral flow device used for contacting the biological sample with the reaction mixture, where a signal is generated to indicate the presence or absence of the target nucleic acid molecule of interest. In addition, the kit may further include instructions for use and other information.

EXAMPLES

The following examples are put forth so as to provide those of ordinary skill in the art with a complete disclosure and description of how to make and use the present invention and are not intended to limit the scope of what the inventors regard as their invention, nor are they intended to represent or imply that the experiments below are all of or the only experiments performed. It will be appreciated by persons skilled in the art that numerous variations and/or modifications may be made to the invention as shown in the specific aspects without departing from the spirit or scope of the invention as broadly described. The present aspects are, therefore, to be considered in all respects as illustrative and not restrictive.

Example I: Preparation of Nucleic Acids of Interest

Mechanical lysis: Nucleic acids of interest may be isolated by various methods depending on the cell type and source (e.g., tissue, blood, saliva, environmental sample, etc.). Mechanical lysis is a widely used cell lysis method and may be used to extract nucleic acids from bacterial, yeast, plant and mammalian cells. Cells are disrupted by agitating a cell suspension with "beads" at high speeds (beads for disrupting various types of cells can be sourced from, e.g., OPS Diagnostics (Lebanon NJ, US) and MP Biomedicals (Irvine, CA, USA)). Mechanical lysis via beads begins with harvesting cells in a tissue or liquid, where the cells are first centrifuged and pelleted. The supernatant is removed and replaced with a buffer containing detergents as well as lysozyme and protease. The cell suspension is mixed to promote breakdown of the proteins in the cells and the cell suspension then is combined with small beads (e.g., glass, steel, or ceramic beads) that are mixed (e.g., vortexed) with the cell suspension at high speeds. The beads collide with the cells, breaking open the cell membrane with shear forces. After "bead beating", the cell suspension is centrifuged to pellet the cellular debris and beads, and the supernatant may be purified via a nucleic acid binding column (such as the MagMAX™ Viral/Pathogen Nucleic Acid Isolation Kit from ThermoFisher (Waltham, MA, USA) and others from Qiagen (Hilden, Germany), TakaraBio (San Jose, CA, USA), and Biocomma (Shenzen, China)) to collect the nucleic acids (see the discussion of solid phase extraction below).

Solid phase extraction (SPE): Another method for capturing nucleic acids is through solid phase extraction. SPE involves a liquid and stationary phase, which selectively separates the target analyte (here, nucleic acids) from the liquid in which the cells are suspended based on specific hydrophobic, polar, and/or ionic properties of the target analyte in the liquid and the stationary solid matrix. Silica binding columns and their derivatives are the most commonly used SPE techniques, having a high binding affinity for DNA under alkaline conditions and increased salt concentration; thus, a highly alkaline and concentrated salt buffer is used. The nucleic acid sample is centrifuged through a column with a highly porous and high surface area silica matrix, where binding occurs via the affinity between negatively charged nucleic acids and positively charged silica material. The nucleic acids bind to the silica matrices, while the other cell components and chemicals pass through the matrix without binding. One or more wash steps typically are performed after the initial sample binding (i.e., the nucleic acids to the matrix), to further purify the bound nucleic acids, removing excess chemicals and cellular components non-specifically bound to the silica matrix. Alternative versions of SPE include reverse SPE and ion exchange SPE, and use of glass particles, cellulose matrices, and magnetic beads.

Thermal lysis: Thermal lysis involves heating a sample of mammalian cells, virions, or bacterial cells at high temperatures thereby damaging the cellular membranes by denaturizing the membrane proteins. Denaturing the membrane proteins results in the release of intracellular DNA. Cells are generally heated above 90° C., however time and temperature may vary depending on sample volume and sample type. Once lysed, typically one or more downstream methods, such as use of nucleic acid binding columns for solid phase extraction as described above, are required to further purify the nucleic acids.

Physical lysis: Common physical lysis methods include sonication and osmotic shock. Sonication involves creating and rupturing of cavities or bubbles to release shockwaves, thereby disintegrating the cellular membranes of the cells. In the sonication process, cells are added into lysis buffer, often containing phenylmethylsulfonyl fluoride, to inhibit proteases. The cell samples are then placed in a water bath and a sonication wand is placed directly into the sample solution. Sonication typically occurs between 20-50 kHz, causing cavities to be formed throughout the solution as a result of the ultrasonic vibrations; subsequent reduction of pressure then causes the collapse of the cavity or bubble resulting in a large amount of mechanical energy being released in the form of a shockwave that propagates through the solution and disintegrates the cellular membrane. The duration of the sonication pulses and number of pulses performed varies depending on cell type and the downstream application. After sonication, the cell suspension typically is centrifuged to pellet the cellular debris and the supernatant containing the nucleic acids may be further purified by solid phase extraction as described above.

Another form of physical lysis is osmotic shock, which is most typically used with mammalian cells. Osmotic shock involves placing cells in DI/distilled water with no salt added. Because the salt concentration is lower in the solution than in the cells, water is forced into the cell causing the cell to burst, thereby rupturing the cellular membrane. The sample is typically purified and extracted by techniques such as e.g., solid phase extraction or other techniques known to those of skill in the art.

Chemical lysis: Chemical lysis involves rupturing cellular and nuclear membranes by disrupting the hydrophobic-hydrophilic interactions in the membrane bilayers via detergents. Salts and buffers (such as, e.g., Tris-HCl pH8) are used to stabilize pH during extraction, and chelating agents (such as ethylenediaminetetraacetic acid (EDTA)) and inhibitors (e.g., Proteinase K) are also added to preserve the integrity of the nucleic acids and protect against degradation. Often, chemical lysis is used with enzymatic disruption methods (see below) for lysing bacterial cell walls. In addition, detergents are used to lyse and break down cellular membranes by solubilizing the lipids and membrane proteins on the surface of cells. The contents of the cells include, in addition to the desired nucleic acids, inner cellular proteins and cellular debris. Enzymes and other inhibitors are added after lysis to inactivate nucleases that may degrade the nucleic acids. Proteinase K is commonly added after lysis, destroying DNase and RNase enzymes capable of degrading the nucleic acids. After treatment with enzymes, the sample is centrifuged, pelleting cellular debris, while the nucleic acids remain in the solution. The nucleic acids may be further purified as described above.

Another form of chemical lysis is the widely used procedure of phenol-chloroform extraction. Phenol-chloroform extraction involves the ability for nucleic acids to remain soluble in an aqueous solution in an acidic environment, while the proteins and cellular debris can be pelleted down via centrifugation. Phenol and chloroform ensure a clear separation of the aqueous and organic (debris) phases. For DNA, a pH of 7-8 is used, and for RNA, a more acidic pH of 4.5 is used.

Enzymatic lysis: Enzymatic disruption methods are commonly combined with other lysis methods such as those described above to disrupt cellular walls (bacteria and plants) and membranes. Enzymes such as lysozyme, lysostaphin, zymolase, and protease are often used in combination with other techniques such as physical and chemical lysis. For example, one can use cellulase to disrupt plant cell walls, lysosomes to disrupt bacterial cell walls and zymolase to disrupt yeast cell walls.

Example II: RNP Formation

For RNP complex formation, 250 nM of LbCas12a nuclease protein was incubated with 375 nM of a target specific gRNA in 1× Buffer (10 mM Tris-HCl, 100 µg/mL BSA) with 2-15 mM MgCl$_2$ at 25° C. for 20 minutes. The total reaction volume was 2 µL. Other ratios of LbCas12a nuclease to gRNAs were tested, including 1:1, 1:2 and 1:5. The incubation temperature ranged from 16° C.-37° C., and the incubation time ranged from 10 minutes to 4 hours.

Example III: Blocked Nucleic Acid Molecule Formation

Ramp cooling: For formation of the secondary structure of blocked nucleic acid molecules, 2.5 µM of a blocked nucleic acid molecule (any of Formulas I-IV) was mixed in a T50 buffer (20 mM Tris HCl, 50 mM NaCl) with 10 mM MgCl$_2$ for a total volume of 50 µL. The reaction was heated to 95° C. at 1.6° C./second and incubated at 95° C. for 5 minutes to dehybridize any secondary structures. Thereafter, the reaction was cooled to 37° C. at 0.015° C./second to form the desired secondary structure.

Snap cooling: For formation of the secondary structure of blocked nucleic acid molecules, 2.5 µM of a blocked nucleic acid molecule (any of Formulas I-IV) was mixed in a T50 buffer (20 mM Tris HCl, 50 mM NaCl) with 10 mM MgCl$_2$ for a total volume of 50 µL. The reaction was heated to 95° C. at 1.6° C./second and incubated at 95° C. for 5 minutes to dehybridize any secondary structures. Thereafter, the reaction was cooled to room temperature by removing the heat source to form the desired secondary structure.

Snap cooling on ice: For formation of the secondary structure of blocked nucleic acid molecules, 2.5 µM of a blocked nucleic acid molecule (any of Formulas I-IV) was mixed in a T50 buffer (20 mM Tris HCl, 50 mM NaCl) with 10 mM MgCl$_2$ for a total volume of 50 µL. The reaction was heated to 95° C. at 1.6° C./second and incubated at 95° C. for 5 minutes to dehybridize any secondary structures. Thereafter, the reaction was cooled to room temperature by placing the reaction tube on ice to form the desired secondary structure.

Example IV: Reporter Moiety Formation

The reporter moieties used in the reactions herein were single-stranded DNA oligonucleotides 5-9 bases in length (e.g., with sequences of TTATT, TTTATTT, ATTAT, ATTT-ATTTA, AAAAA, or AAAAAAAAA) with a fluorophore and a quencher attached on the 5' and 3' ends, respectively. In one example using a Cas12a cascade, the fluorophore was FAM-6 and the quencher was IOWA BLACK® (Integrated DNA Technologies, Coralville, IA). In another example using a Cas13 cascade, the reporter moieties were single-stranded RNA oligonucleotides 5-10 bases in length (e.g., r(U)n, r(UUAUU)n, r(A)n).

Example V: Cascade Assay

Format I (final reaction mix components added at the same time): RNP1 was assembled using the LbCas12a nuclease and a gRNA for the Methicillin resistant *Staphylococcus aureus* (MRSA) DNA according to the RNP complex formation protocol described in Example II (for this sequence, see Example VI). Briefly, 250 nM LbCas12a nuclease was assembled with 375 nM of the MRSA-target specific gRNA. Next, RNP2 was formed using the LbCas12a nuclease and a gRNA specific for a selected blocked nucleic acid molecule (Formula I-IV) using 500 nM LbCas12a nuclease assembled with 750 nM of the blocked nucleic acid-specific gRNA incubated in 1×NEB 2.1 Buffer (New England Biolabs, Ipswich, MA) with 5 mM MgCl$_2$ at 25° C. for 20-40 minutes. Following incubation, RNP1s were diluted to a concentration of 75 nM LbCas12a: 112.5 nM gRNA. Thereafter, the final reaction was carried out in 1×Buffer, with 500 nM of the ssDNA reporter moiety, 1×ROX dye (Thermo Fisher Scientific, Waltham, MA) for passive reference, 2.5 mM MgCl$_2$, 4 mM NaCl, 15 nM LbCas12a: 22.5 nM gRNA RNP1, 20 nM LbCas12a: 35 nM gRNA RNP2, and 50 nM blocked nucleic acid molecule (any one of Formula I-IV) in a total volume of 9 µL. 1 µL of MRSA DNA target (with samples having as low as three copies and as many as 30,000 copies—see FIGS. 6-14) was added to make a final volume of 10 µL. The final reaction was incubated in a thermocycler at 25° C. with fluorescence measurements taken every 1 minute.

Format II (RNP1 and MRSA target pre-incubated before addition to final reaction mix): RNP1 was assembled using the LbCas12a nuclease and a gRNA for the MRSA DNA according to RNP formation protocol described in Example II (for this sequence, see Example VI). Briefly, 250 nM LbCas12a nuclease was assembled with 375 nM of the MRSA-target specific gRNA. Next, RNP2 was formed using the LbCas12a nuclease and a gRNA specific for a selected blocked nucleic acid molecule (Formula I-IV) using 500 nM LbCas12a nuclease assembled with 750 nM of the blocked nucleic acid-specific gRNA incubated in 1×NEB 2.1 Buffer (New England Biolabs, Ipswich, MA) with 5 mM MgCl$_2$ at 25° C. for 20-40 minutes. Following incubation, RNP1s were diluted to a concentration of 75 nM LbCas12a: 112.5 nM gRNA. After dilution, the formed RNP1 was mixed with 1 µL of MRSA DNA target and incubated at 16° C.-37° C. for up to 10 minutes to activate RNP1. The final reaction was carried out in 1× Buffer, with 500 nM of the ssDNA reporter moiety, 1×ROX dye (Thermo Fisher Scientific, Waltham, MA) for passive reference, 2.5 mM MgCl$_2$, 4 mM NaCl, the pre-incubated and activated RNP1, 20 nM LbCas12a: 35 nM gRNA RNP2, and 50 nM blocked nucleic acid molecule (any one of Formula I-IV) in a total volume of 9 µL. The final reaction was incubated in a thermocycler at 25° C. with fluorescence measurements taken every 1 minute.

Format III (RNP1 and MRSA target pre-incubated before addition to final reaction mix and blocked nucleic acid molecule added to final reaction mix last): RNP1 was assembled using the LbCas12a nuclease and a gRNA for the MRSA DNA according to the RNP complex formation protocol described in Example II (for this sequence, see Example VI). Briefly, 250 nM LbCas12a nuclease was assembled with 375 nM of the MRSA-target specific gRNA. Next, RNP2 was formed using the LbCas12a nuclease and a gRNA specific for a selected blocked nucleic acid molecule (Formula I-IV) using 500 nM LbCas12a nuclease assembled with 750 nM of the blocked nucleic acid-specific gRNA incubated in 1×NEB 2.1 Buffer (New England Biolabs, Ipswich, MA) with 5 mM MgCl$_2$ at 25° C. for 20-40 minutes. Following incubation, RNP1s were diluted to a concentration of 75 nM LbCas12a: 112.5 nM gRNA. After dilution, the formed RNP1 was mixed with 1 µL of MRSA DNA target and incubated at 16° C.-37° C. for up to 10 minutes to activate RNP1. The final reaction was carried out in 1× Buffer, with 500 nM of the ssDNA reporter moiety, 1×ROX dye (Thermo Fisher Scientific, Waltham, MA) for passive reference, 2.5 mM MgCl$_2$, 4 mM NaCl, the pre-incubated and activated RNP1, and 20 nM LbCas12a: 35 nM gRNA RNP2 in a total volume of 9 µL. Once the reaction mix was made, 1 µL (50 nM) blocked nucleic acid molecule (any one of Formula I-IV) was added for a total volume of 10 μL. The final reaction was incubated in a thermocycler at 25° C. with fluorescence measurements taken every 1 minute.

Example VI: Detection of MRSA and Test Reaction Conditions

To detect the presence of Methicillin resistant *Staphylococcus aureus* (MRSA) and determine the sensitivity of detection with the cascade assay, titration experiments with a MRSA DNA target nucleic acid of interest were performed. The MRSA DNA sequence (NCBI Reference Sequence NC: 007793.1) is as follows.

SEQ ID NO: 615:
ATGAAAAAGATAAAAATTGTTCCACTTATTTTAATAGTTGTAGTTGTCGG
GTTTGGTATATATTTTTATGCTTCAAAAGATAAAGAAATTAATAATACTA
TTGATGCAATTGAAGATAAAAATTTCAAACAAGTTTATAAAGATAGCAGT
TATATTTCTAAAAGCGATAATGGTGAAGTAGAAATGACTGAACGTCCGAT
AAAAATATATAATAGTTTAGGCGTTAAAGATATAAACATTCAGGATCGTA
AAATAAAAAAGTATCTAAAAATAAAAAACGAGTAGATGCTCAATATAAA
ATTAAAACAAACTACGGTAACATTGATCGCAACGTTCAATTTAATTTTGT
TAAAGAAGATGGTATGTGGAAGTTAGATTGGGATCATAGCGTCATTATTC
CAGGAATGCAGAAAGACCAAAGCATACATATTGAAAATTTAAAATCAGAA
CGTGGTAAAATTTTAGACCGAAACAATGTGGAATTGGCCAATACAGGAAC
AGCATATGAGATAGGCATCGTTCCAAAGAATGTATCTAAAAAAGATTATA
AAGCAATCGCTAAAGAACTAAGTATTTCTGAAGACTATATCAAACAACAA
ATGGATCAAAATTGGGTACAAGATGATACCTTCGTTCCACTTAAAACCGT
TAAAAAAATGGATGAATATTTAAGTGATTTCGCAAAAAAATTTCATCTTA
CAACTAATGAAACAGAAAGTCGTAACTATCCTCTAGGAAAAGCGACTTCA
CATCTATTAGGTTATGTTGGTCCCATTAACTCTGAAGAATTAAAACAAAA
AGAATATAAAGGCTATAAAGATGATGCAGTTATTGGTAAAAAGGGACTCG
AAAAACTTTACGATAAAAAGCTCCAACATGAAGATGGCTATCGTGTCACA
ATCGTTGACGATAATAGCAATACAATCGCACATACATTAATAGAGAAAA
GAAAAAAGATGGCAAAGATATTCAACTAACTATTGATGCTAAAGTTCAAA
AGAGTATTTATAACAACATGAAAAATGATTATGGCTCAGGTACTGCTATC
CACCCTCAAACAGGTGAATTATTAGCACTTGTAAGCACACCTTCATATGA
CGTCTATCCATTTATGTATGGCATGAGTAACGAAGAATATAATAAATTAA
CCGAAGATAAAAAAGAACCTCTGCTCAACAAGTTCCAGATTACAACTTCA
CCAGGTTCAACTCAAAAAATATTAACAGCAATGATTGGGTTAAATAACAA
AACATTAGACGATAAAACAAGTTATAAAATCGATGGTAAAGGTTGGCAAA
AAGATAAATCTTGGGGTGGTTACAACGTTACAAGATATGAAGTGGTAAAT
GGTAATATCGACTTAAAACAAGCAATAGAATCATCAGATAACATTTTCTT
TGCTAGAGTAGCACTCGAATTAGGCAGTAAGAAATTTGAAAAAGGCATGA
AAAAACTAGGTGTTGGTGAAGATATACCAAGTGATTATCCATTTTATAAT
GCTCAAATTTCAAACAAAAATTTAGATAATGAAATATTATTAGCTGATTC
AGGTTACGGACAAGGTGAAATACTGATTAACCCAGTACAGATCCTTTCAA

TCTATAGCGCATTAGAAAATAATGGCAATATTAACGCACCTCACTTATTA
AAAGACACGAAAAACAAAGTTTGGAAGAAAAATATTATTTCCAAAGAAAA
TATCAATCTATTAACTGATGGTATGCAACAAGTCGTAAATAAAACACATA
AAGAAGATATTTATAGATCTTATGCAAACTTAATTGGCAAATCCGGTACT
GCAGAACTCAAAATGAAACAAGGAGAAACTGGCAGACAAATTGGGTGGTT
TATATCATATGATAAAGATAATCCAAACATGATGATGGCTATTAATGTTA
AAGATGTACAAGATAAAGGAATGGCTAGCTACAATGCCAAAATCTCAGGT
AAAGTGTATGATGAGCTATATGAGAACGGTAATAAAAAATACGATATAGA
TGAATAA

Figure 10A:
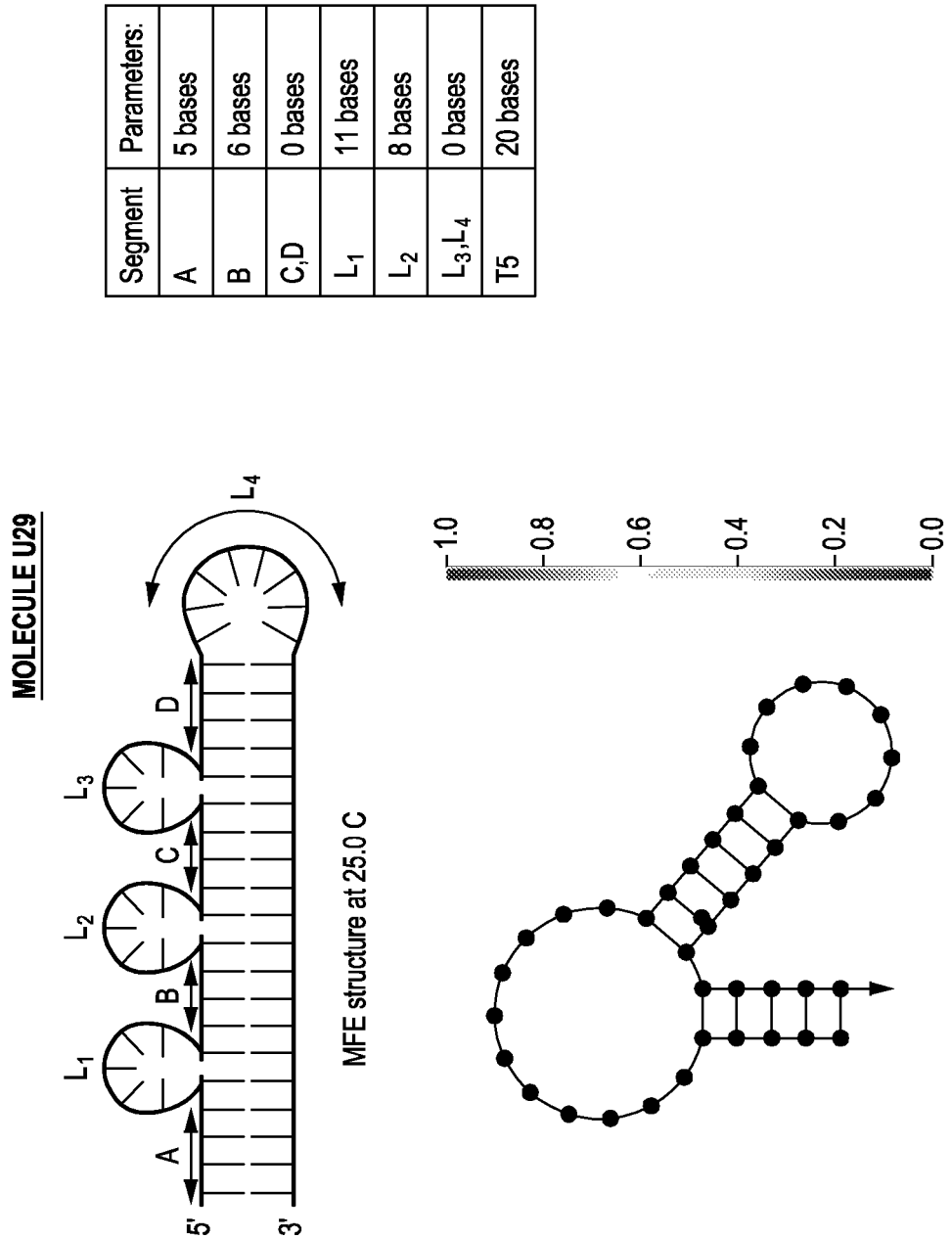
FIG. 10A depicts Molecule U29 and describes the properties thereof.

Briefly, a RNP1 was preassembled with a gRNA sequence designed to target MRSA DNA. Specifically, RNP1 was designed to target a 20 bp region of the mecA gene of MRSA: TGTATGGCATGAGTAACGAA (SEQ ID NO: 616). An RNP2 was preassembled with a gRNA sequence designed to target the unblocked nucleic acid molecule that results from unblocking (i.e., linearizing) blocked nucleic acid molecule U29 (FIG. 10A). The reaction mix contained the preassembled RNP1, preassembled RNP2, and a blocked nucleic acid molecule, in a buffer (pH of about 8) containing 4 mM $MgCl_2$ and 101 mM NaCl.

Figure 10B:
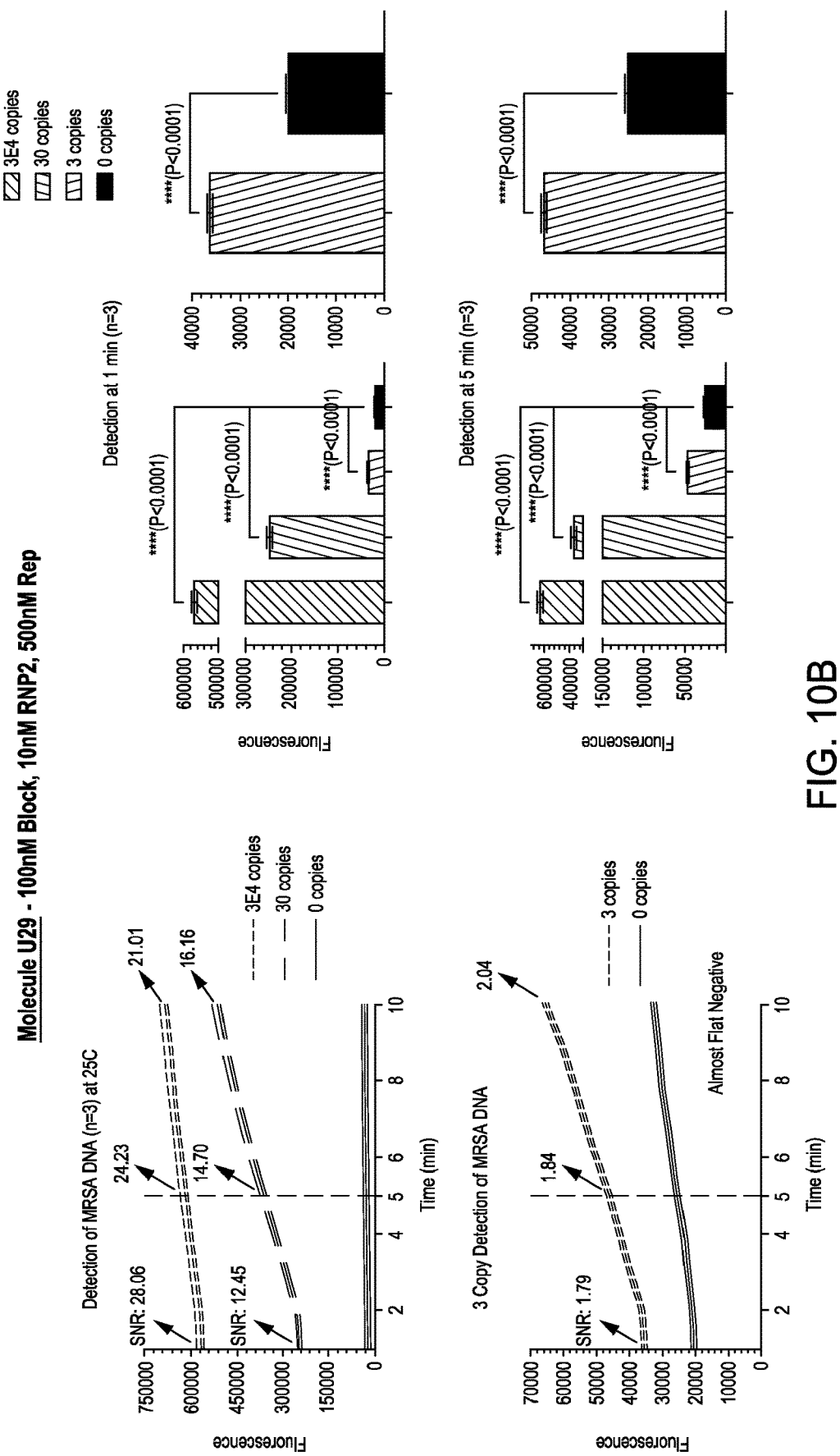
FIGS. 10B-10H show the results achieved for detection of 3E4 copies, 30 copies, 3 copies and 0 copies of the mecA gene of MRSA (n=3) at 25° C. with varying conentrations of Molecule U29, RNP2 and reported moiety.

FIG. 10A shows the structure and segment parameters of molecule U29. Note molecule U29 has a secondary structure free energy value of −5.84 kcal/mol and relatively short self-hybridizing, double-stranded regions of 5 bases and 6 bases. FIGS. 10B-10H show the results achieved for detection of 3E4 copies, 30 copies, 3 copies and 0 copies of the mecA gene of MRSA (n=3) at 25° C. with varying concentrations of blocked nucleic acid, RNP2 and reporter moiety. FIG. 10B shows the results achieved when 100 nM blocked nucleic acid molecules, 10 nM RNP2s and 500 nM reporter moieties are used. Thus, in this experiment, the ratio of blocked nucleic acid molecules to RNP2s is 10:1. Note first that with 3E4 copies, nearly 100% of the reporters are cleaved at t=0 with a signal-to-noise ratio of 28.06 at 0 minutes, a signal-to-noise ratio of 24.23 at 5 minutes, and a signal-to-noise ratio of 21.01 at 10 minutes. Additionally, the signal-to-noise ratios for detection with 30 copies of MRSA target is 12.45 at 0 minutes, 14.07 at 5 minutes and 16.16 at 10 minutes; and the signal-to-noise ratios for detection with 3 copies of MRSA target is 1.79 at 0 minutes, 1.64 at 5 minutes and is 2.04 at 10 minutes. Note the measured fluorescence at 0 copies increases only slightly over the 10- and 30-minutes intervals, resulting in a flat negative. A flat negative (the results obtained over the time period for 0 copies) demonstrates that there is very little non-specific or undesired signal generation in the system. Note that the negative when the ratio of blocked nucleic acid molecules to RNP2s is 10:1 is flatter than those in FIGS. 10C through 10H.

Figure 10C:
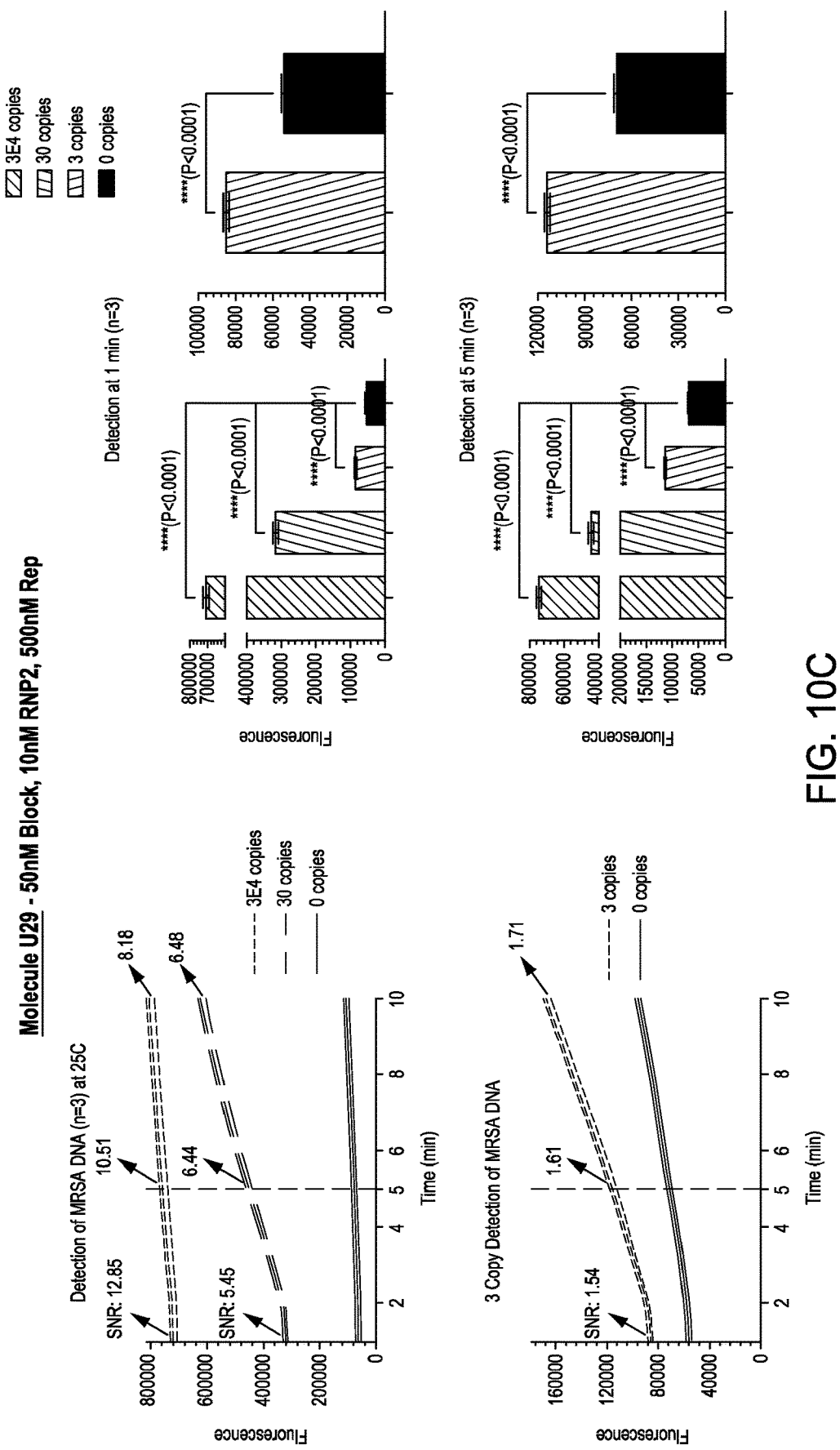

FIG. 10C shows the results achieved when 50 nM blocked nucleic acid molecules, 10 nM RNP2s and 500 nM reporter moieties are used. Thus, in this experiment, the ratio of blocked nucleic acid molecules to RNP2s is 5:1. Note first that with 3E4 copies, again nearly 100% of the reporters are cleaved at t=0 with a signal-to-noise ratio of 12.85, a signal-to-noise ratio of 10.51 at 5 minutes, and a signal-to-noise ratio of 8.18 at 10 minutes. Additionally, the signal-to-noise ratios for detection with 30 copies of MRSA target is 5.85 at 0 minutes, 6.44 at 5 minutes and 6.48 at 10 minutes; and the signal-to-noise ratios for detection with 3 copies of MRSA target is 1.54 at 0 minutes, 1.61 at 5 minutes and is 1.71 at 10 minutes. Note the measured fluorescence at 0 copies increases, resulting in less of a flat negative than the 10:1 ratio of blocked nucleic acid molecules to RNP2.

Figure 10D:
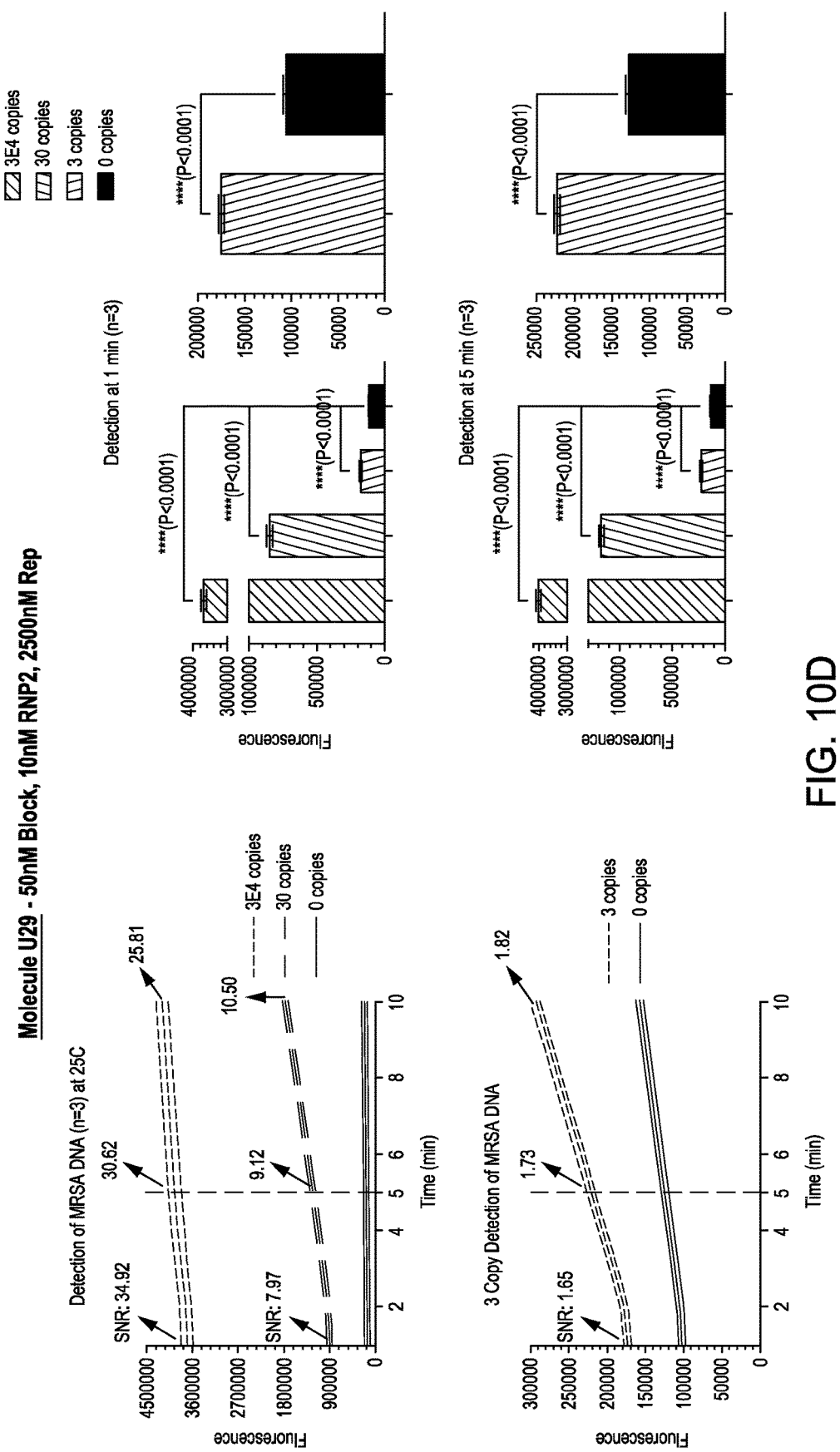

FIG. 10D shows the results achieved when 50 nM blocked nucleic acid molecules, 10 nM RNP2s and 2500 nM reporter moieties are used. Thus, in this experiment, the ratio of blocked nucleic acid molecules to RNP2s is 5:1. With 3E4 copies, again nearly 100% of the reporters are cleaved at t=0 with a signal-to-noise ratio of 34.92, a signal-to-noise ratio of 30.62 at 5 minutes, and a signal-to-noise ratio of 25.81 at 10 minutes. Additionally, the signal-to-noise ratios for detection with 30 copies of MRSA target is 7.97 at 0 minutes, 1.73 at 5 minutes and 10.50 at 10 minutes; and the signal-to-noise ratios for detection with 3 copies of MRSA target is 1.65 at 0 minutes, 1.73 at 5 minutes and is 1.82 at 10 minutes. Note the measured fluorescence at 0 copies increases, resulting in less of a flat negative than the 10:1 ratio of blocked nucleic acid molecules to RNP2s, but likely due to the 5×increase in the concentration of reporter moieties; however, note also that a higher concentration of reporter moieties allows for a higher signal-to-noise ratio for 3E4 and 30 copies of MRSA target.

Figure 10E:
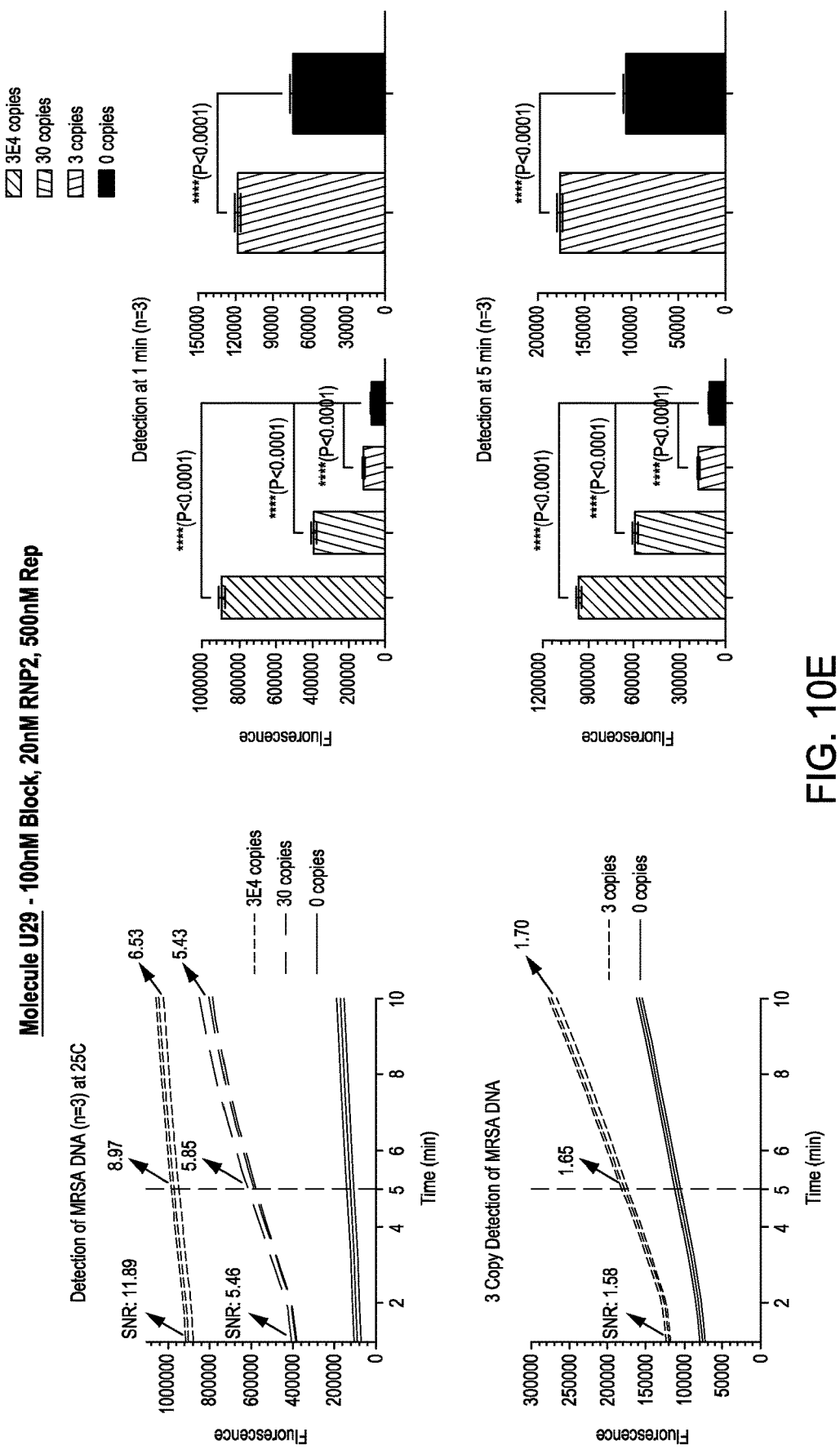

FIG. 10E shows the results achieved when 100 nM blocked nucleic acid molecules, 20 nM RNP2s and 500 nM reporter moieties are used and 4 mM NaCl. Thus, in this experiment, the ratio of blocked nucleic acid molecules to RNP2s is 5:1 but double the concentration of both of these molecules than that shown in FIGS. 10C and 10D. With 3E4 copies, again nearly 100% of the reporters are cleaved at t=0 with a signal-to-noise ratio of 11.89, a signal-to-noise ratio of 8.97 at 5 minutes, and a signal-to-noise ratio of 6.53 at 10 minutes. Additionally, the signal-to-noise ratios for detection with 30 copies of MRSA target is 5.46 at 0 minutes, 5.85 at 5 minutes and 5.43 at 10 minutes; and the signal-to-noise ratios for detection with 3 copies of MRSA target is 1.58 at 0 minutes, 1.65 at 5 minutes and 1.80 at 10 minutes. Note the measured fluorescence at 0 copies increases, resulting in less of a flat negative than the 10:1 ratio of blocked nucleic acid molecules to RNP2s shown in FIG. 10B. Note also that the ratio of blocked nucleic acid molecules to RNP2s (5:1) appears to be more important than the ultimate concentration (100 nM/20 nM) by comparison to FIG. 10D where the ratio of blocked nucleic acid molecules to RNP2s was also 5:1 however the concentration of blocked nucleic acid molecules was 50 nM and the concentration of RNP2 was 10 nM.

Figure 10F:
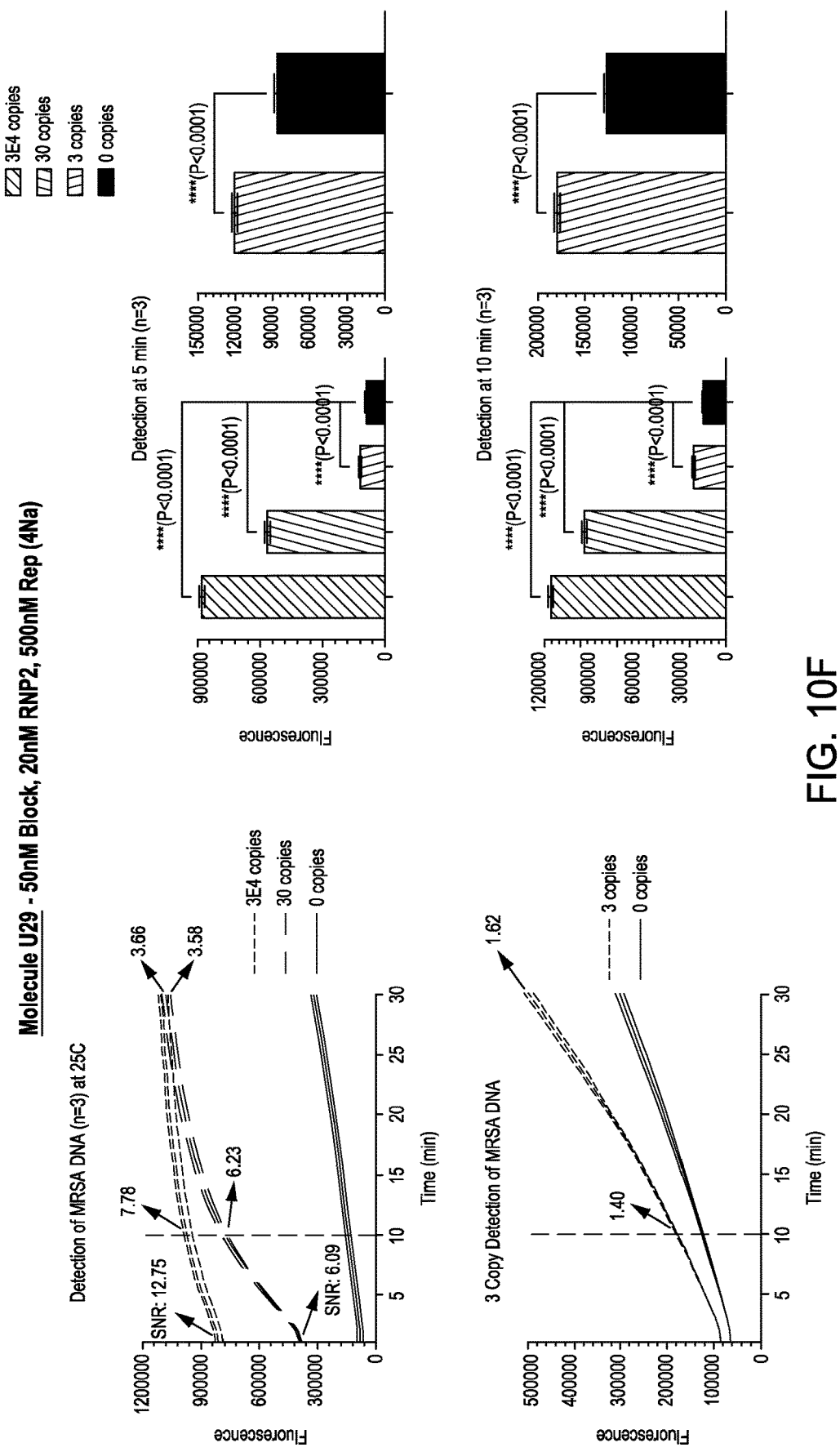

FIG. 10F shows the results achieved when 50 nM blocked nucleic acid molecules, 20 nM RNP2s and 500 nM reporter moieties are used and using a concentration of 4 mM NaCl. In this experiment the ratio of blocked nucleic acid molecules to RNP2s is 2.5:1. With 3E4 copies, again nearly 100% of the reporters are cleaved at t=0 with a signal-to-noise ratio of 25.85, a signal-to-noise ratio of 21.36 at 5 minutes, and a signal-to-noise ratio of 16.24 at 10 minutes. Additionally, the signal-to-noise ratios for detection with 30 copies of MRSA target is 5.28 at 0 minutes, 6.19 at 5 minutes and 7.02 at 10 minutes; and the signal-to-noise ratios for detection with 3 copies of MRSA target is very low at 0 minutes, 1.53 at 5 minutes and is 1.73 at 10 minutes. Note the measured fluorescence at 0 copies increases, resulting in less of a flat negative than the 10:1 ratio of blocked nucleic acid molecules to RNP2s shown in FIG. 10B. Note also that the signal-to-noise ratio for all concentrations was reduced at the 2.5:1 ratio of blocked nucleic acid molecules to RNP2s.

Figure 10G:
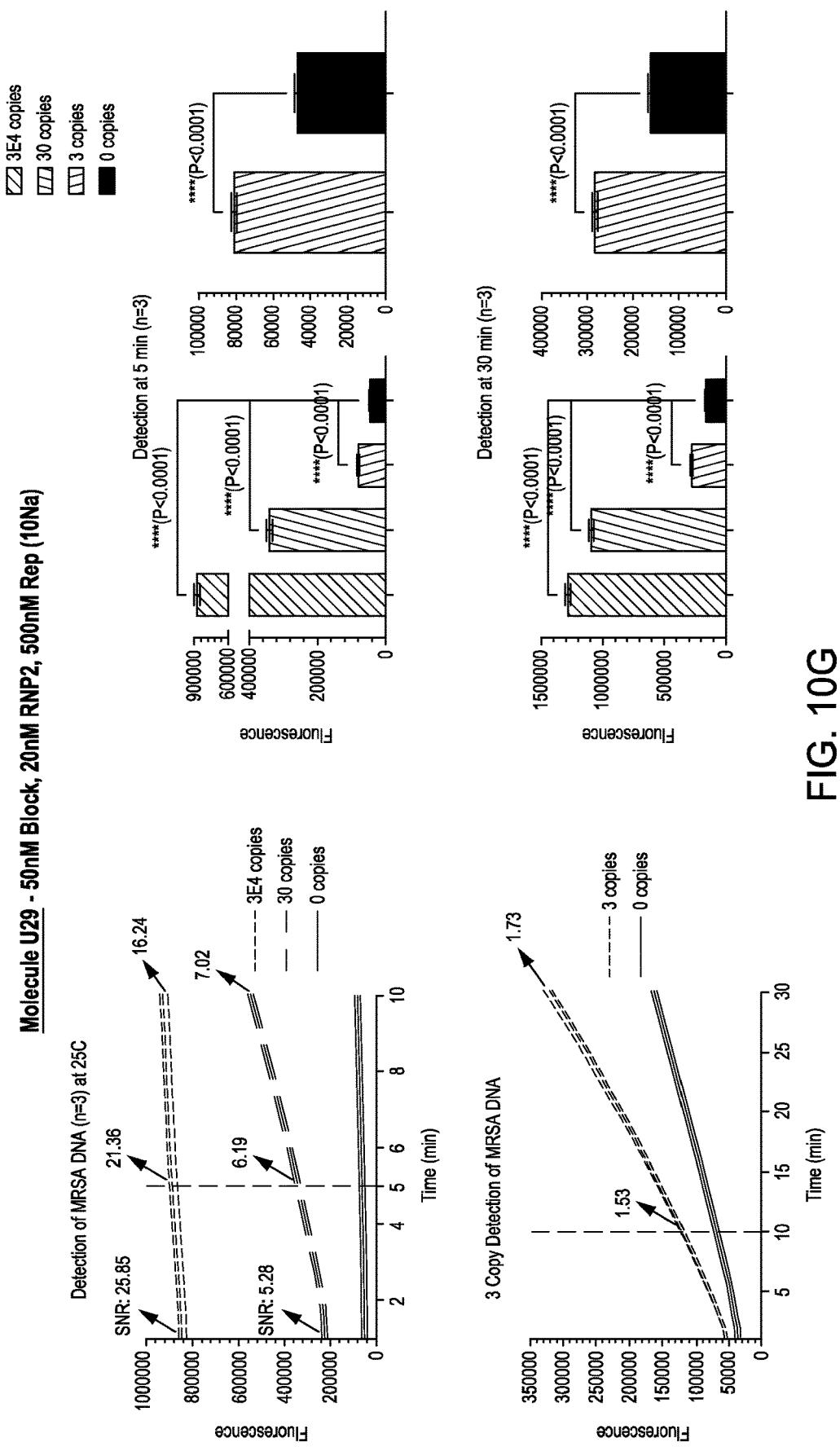

FIG. 10G shows the results achieved when 50 nM blocked nucleic acid molecules, 20 nM RNP2s and 500 nM reporter moieties are used and using a concentration of 10 mM NaCl. Thus, in this experiment, the ratio of blocked nucleic acid molecules to RNP2s is 2.5:1. With 3E4 copies, again nearly 100% of the reporters are cleaved at t=0 with a signal-to-noise ratio of 12.75, a signal-to-noise ratio of 7.78 at 5 minutes, and a signal-to-noise ratio of 3.66 at 10 minutes. Additionally, the signal-to-noise ratios for detection with 30 copies of MRSA target is 6.09 at 0 minutes, 6.23 at 5 minutes and 3.58 at 10 minutes; and the signal-to-noise ratios for detection with 3 copies of MRSA target is very low at 0 minutes, 1.40 at 5 minutes and is 1.62 at 10 minutes. Note the measured fluorescence at 0 copies increases, resulting in less of a flat negative than the 10:1 ratio of blocked nucleic acid molecules to RNP2s shown in FIG. 10B. Note also that the signal-to-noise ratio for all concentrations was reduced substantially at the 2.5:1 ratio of blocked nucleic acid molecules to RNP2s and that the NaCl concentration at 10 mM vs. 4 mM (FIG. 10F) did not make much of a difference.

Figure 10H:
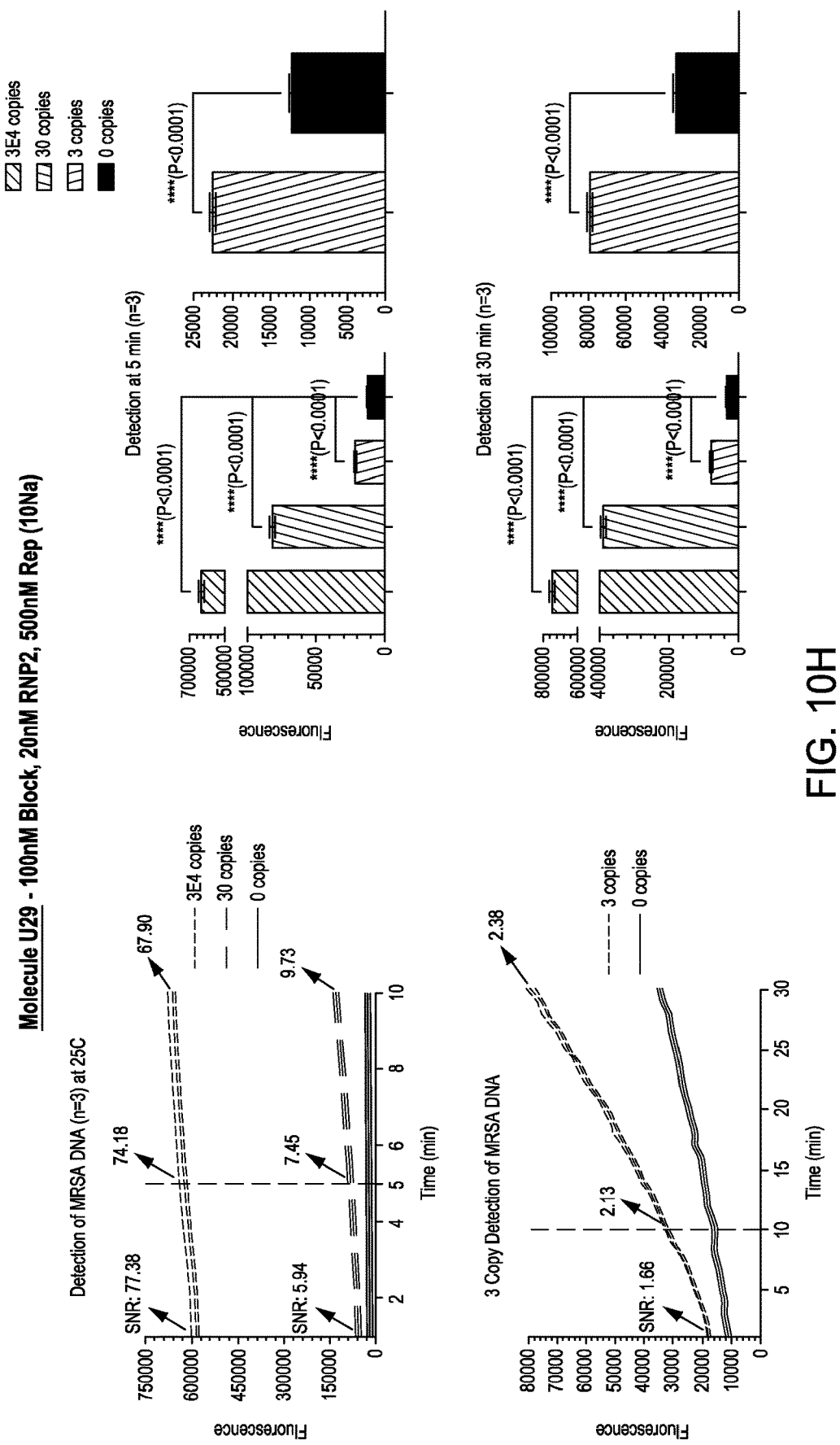

FIG. 10H shows the results achieved when 100 nM blocked nucleic acid molecules, 20 nM RNP2s and 500 nM reporter moieties are used and using a concentration of 10 mM NaCl. Thus, in this experiment, the ratio of blocked nucleic acid molecules to RNP2s is 5:1. With 3E4 copies, again nearly 100% of the reporters are cleaved at t=0 with a signal-to-noise ratio of 77.38, a signal-to-noise ratio of 74.18 at 5 minutes, and a signal-to-noise ratio of 67.90 at 10 minutes. Additionally, the signal-to-noise ratios for detection with 30 copies of MRSA target is 5.94 at 0 minutes, 7.45 at 5 minutes and 9.73 at 10 minutes; and the signal-to-noise ratios for detection with 3 copies of MRSA target is 1.66 at 0 minutes, 2.13 at 5 minutes and is 2.38 at 10 minutes. Note the measured fluorescence at 0 copies increases slightly, resulting in less of a flat negative than the 10:1 ratio of blocked nucleic acid molecules to RNP2s shown in FIG. 10B. Note also that the signal-to-noise ratio for all concentrations was increased substantially at the 5:1 ratio of blocked nucleic acid molecules to RNP2s as compared to the 2.5:1 ration of blocked nucleic acid molecules to RNP2s. In summary, the results shown in FIGS. 10B-10H indicate that a 5:1 ratio of blocked nucleic acid molecules to RNP2s or greater leads to higher signal-to-noise ratios for all concentrations of MRSA target.

Example VII: Homology Modeling and Mutation Structure Analysis

The variant nucleic acid-guided nucleases presented herein were developed in the following manner: For protein engineering and amino acid substitution model predictions, a first Protein Data Bank (pdb) file with the amino acid sequence and structure information for the RNP comprising the base nucleic acid-guided nuclease to be mutated, the gRNA and a bound dsDNA target nucleic acid was obtained. (For structural information for RNPs comprising AsCas12s and LbCas12a, see, e.g., Yamano, et al., Molecular Cell, 67:633-45 (2017).) Desired and/or random amino acid substitutions were then "made" to the base nucleic acid-guided nuclease (LbCas12a), the resulting structural change to the base nucleic acid-guided nuclease due to each amino acid substitution was used to generate updated files for the resulting RNPs comprising each of the variant nucleic acid-guided nucleases using SWISS-MODEL and the original pdf file as a reference template. SWISS-MODEL worked well in the present case as the amino acid sequences of wildtype LbCas12a was known, as were the planned amino acid substitutions. The output of the updated files for each variant nucleic acid-guided nuclease included a root mean square deviation (RMSD) value for the structural changes compared to the RNP complex for wt LbCas12a in Angstrom units (i.e., a measurement of the difference between the backbones of wt LbCas12a and the variant nucleic acid-guided nuclease) and the updated pdb files of the variant nucleic acid-guided nucleases are further assessed at the point of mutations for changes in the hydrogen bonds compared to the reference original pdb file of the nuclease.

After SWISS modeling, an independent step for calculating free energy was performed using, e.g., a Flex ddG module based on the program Rosetta CM to extract locally destabilizing mutations. This was used as a proxy for amino acid interference with PAM regions of the DNA to assess the probability of unwinding of the target nucleic acid. (See, e.g., Shanthirabalan, et al., Proteins: Structure, Function, and Bioinformatics 86(8):853-867 (2018); and Barlow, et al., J. Physical Chemistry B, 122(21):5389-99 (2018).)

Generally, the results of the SWISS-Model and Rosetta analysis indicated that stable enzyme function related to the PAM domain would require a global RMSD value range from 0.1 to 2.1 angstroms, and the following ΔΔG Flex Values: for stabilizing mutations ΔΔG≤−1.0 kcal/mol; for neutral mutations: −1.0 kcal/mol<ΔΔG<1.0 kcal/mol; and for destabilizing mutations: ΔΔG≥1.0 kcal/mol. Sixteen single mutations were identified that, singly or in combination, met the calculated criteria. Structural modeling for mutations at four exemplary amino acid residues are described below.

FIG. 6A shows the result of protein structure prediction using Rosetta and SWISS modeling of wildtype LbCas12a (Lachnospriaceae bacterium Cas12a). Protein structure prediction using Rossetta and SWISS modeling of exemplary variants of wildtype LbCas12a are shown below.

Figure 11A:
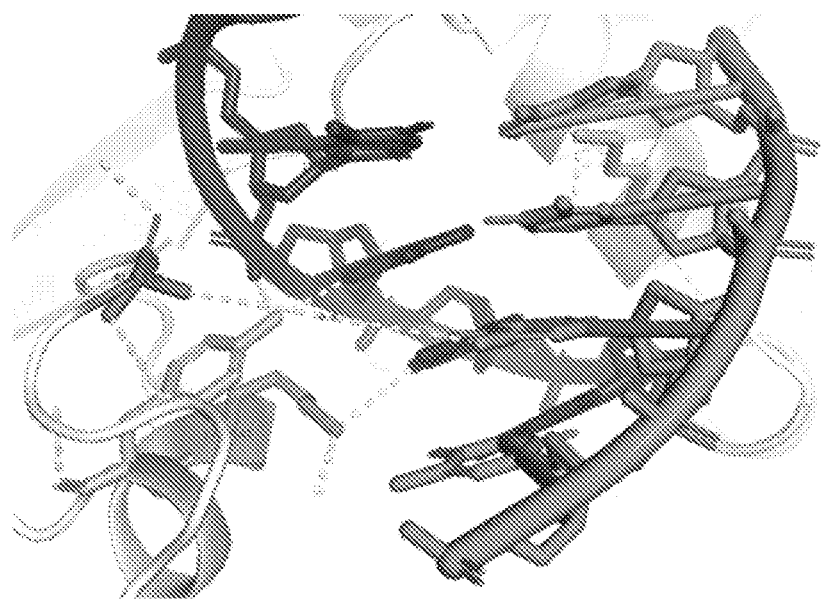
FIG. 11A shows the result of protein structure prediction using Rosetta and SWISS modeling of LbCas12a comprising the mutation G532A in the wildtype sequence.
Figure 11B:
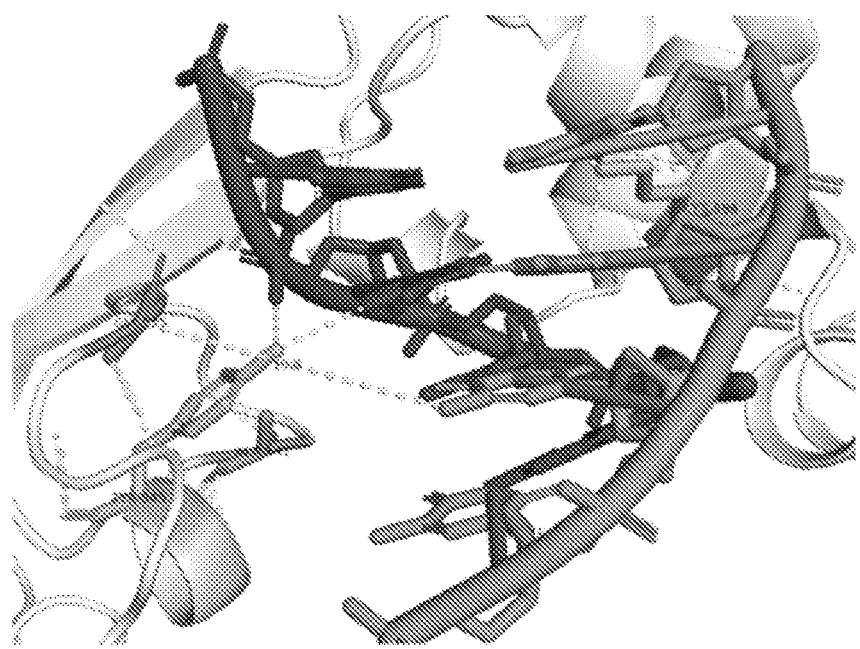
FIG. 11B shows the result of protein structure prediction using Rosetta and SWISS modeling of LbCas12a comprising the mutation K538A in the wildtype sequence.

Mutation 1, G532A: The structure of an RNP comprising the G532A variant nucleic acid-guided nuclease is shown in FIG. 11A. Modeling indicated the following changes to the wildtype LbCas12a structure with the G532A substitution (seen in FIG. 11A as a red residue): loss of one hydrogen bond with TS-PAM (target strand PAM) at amino acid residue 595; loss of one hydrogen bond with NTS-PAM (non-target strand PAM) at amino acid residue 595; no addition or loss of a hydrogen bond at amino acid residue 532. Per simulations, mutation G532A is a structurally stabilizing mutation. The parameters collected from SWISS-MODEL and Rosetta analysis are shown in Table 17.

TABLE 17

Mutation 1: G532A
Global RMSD: 0.976
PI RMSD: 0.361
REC1 RMSD: 0.289 (235 to 235 atoms)
WED RMSD: 0.306 (198 to 198 atoms)
ΔΔG Flex Value: −1.13

PI = PAM-interacting domain of the G532A variant
REC1 = REC1 domain of the G532A variant
WED = WED domain of the G532A variant Mutation 2, K538A: The structure of an RNP comprising the K538A variant nucleic acid-guided nuclease is shown at left in FIG. 11B. Modeling indicated the following changes to the wildtype LbCas12a structure with the K538A substitution (seen in FIG. 11B as a pink residue): loss of one hydrogen bond with TS-PAM (target strand PAM) at amino acid residue 538; loss of one hydrogen bond with TS-PAM (target strand PAM) at amino acid residue 595; loss of one hydrogen bond with NTS-PAM (non-target strand PAM) at amino acid residue 595. Per simulations, mutation K538A is a structurally stabilizing mutation. The parameters collected from SWISS-MODEL and Rosetta analysis are shown in Table 18.

TABLE 18

Mutation 2: K538A
Global RMSD: 0.990
PI RMSD: 0.376
REC1 RMSD: 0.305 (236 to 236 atoms)
WED RMSD: 0.324 (194 to 194 atoms)
ΔΔG Flex Value: 0.06

Figure 11C:
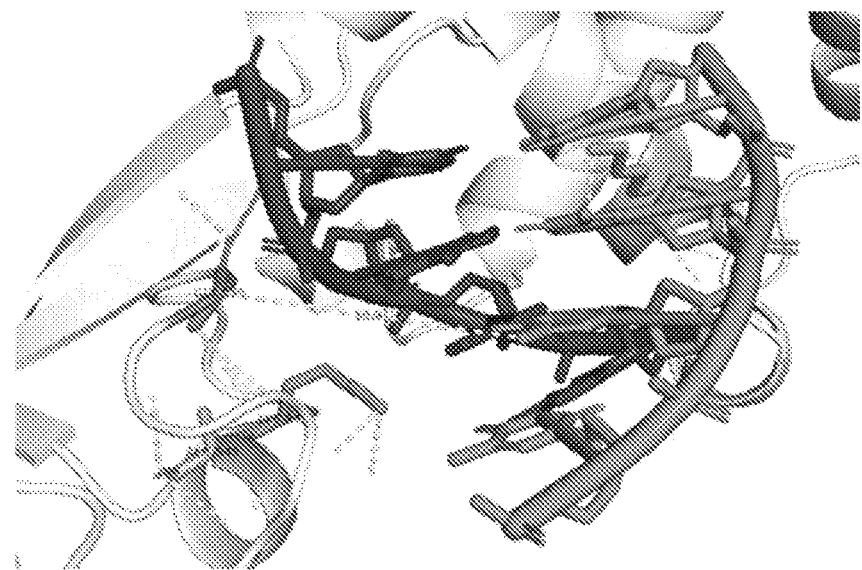
FIG. 11C shows the result of protein structure prediction using Rosetta and SWISS modeling of LbCas12a comprising the mutation Y542A in the wildtype sequence.

PI = PAM-interacting domain of the K538A variant
REC1 = REC1 domain of the K538A variant
WED = WED domain of the K538A variant Mutation 3, Y542A: The structure of an RNP comprising the Y542A variant nucleic acid-guided nuclease is shown in FIG. 11C. Modeling indicated the following changes to the wildtype LbCas12a structure with the Y542A substitution (seen in FIG. 11C as a blue residue): loss of two hydrogen bonds with TS-PAM (target strand PAM) at amino acid residue 542; loss of one hydrogen bond with TS-PAM (target strand PAM) at amino acid residue 538; loss of one hydrogen bond with TS-PAM (target strand PAM) at amino acid residue 595; loss of one hydrogen bond with NTS-PAM (non-target strand PAM) at amino acid residue 595. Per simulations, mutation Y542A is a structurally stabilizing mutation. The parameters collected from SWISS-MODEL and Rosetta analysis are shown in Table 19.

TABLE 19

Mutation 3: Y542A
Global RMSD: 0.989
PI RMSD: 0.377
REC1 RMSD: 0.306 (237 to 237 atoms)
WED RMSD: 0.338 (199 to 199 atoms)
ΔΔG Flex Value: −2.06

Figure 11D:
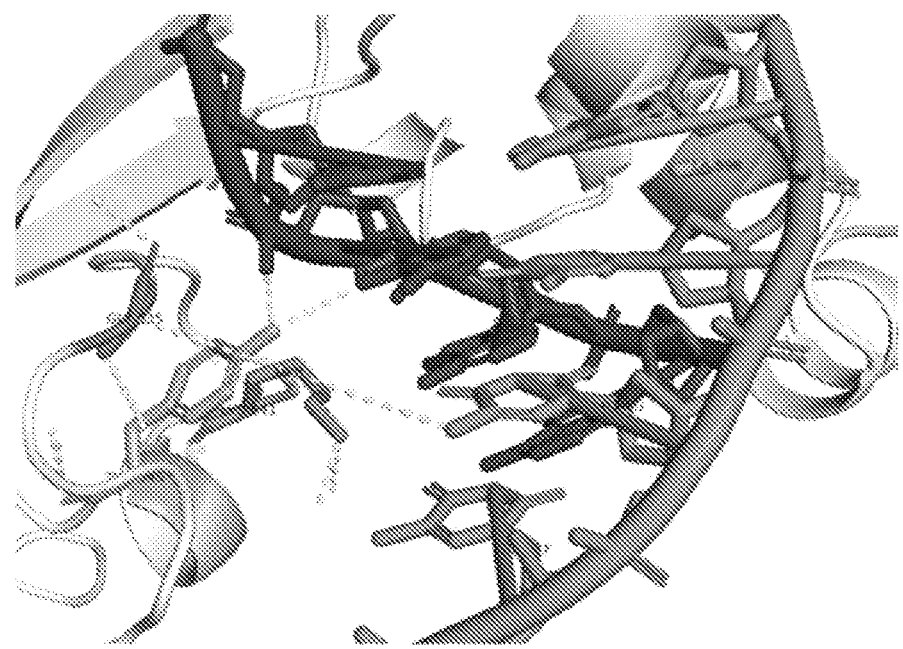
FIG. 11D shows the result of protein structure prediction using Rosetta and SWISS modeling of LbCas12a comprising the mutation K595A in the wildtype sequence.

PI = PAM-interacting domain of the Y542A variant
REC1 = REC1 domain of the Y542A variant
WED = WED domain of the Y542A variant Mutation 4, K595A: The structure of an RNP comprising the K595A variant nucleic acid-guided nuclease is shown in FIG. 11D. Modeling indicated the following changes to the wildtype LbCas12a structure with the K595A substitution (seen in FIG. 11D as an orange residue): loss of two hydrogen bonds with TS-PAM (target strand PAM) at amino acid residue 595; loss of one hydrogen bond with NTS-PAM (non-target strand PAM) at amino acid residue 595; loss of one hydrogen bond with NTS-PAM (non-target strand PAM) at amino acid residue 538. Per simulations, mutation K595A is a structurally destabilizing mutation. The parameters collected from SWISS-MODEL and Rosetta analysis are shown in Table 20.

TABLE 20

Mutation 4: K595A
Global RMSD: 0.976
PI RMSD: 0.361
REC1 RMSD: 0.289 (235 to 235 atoms)
WED RMSD: 0.306 (198 to 198 atoms)
ΔΔG Flex Value: 1.26

Figure 11E:
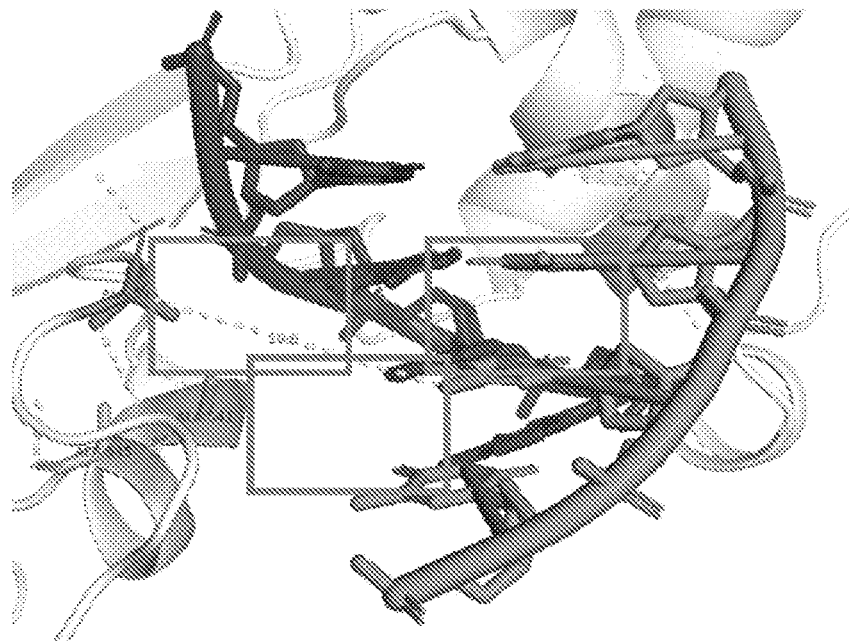
FIG. 11E shows the result of protein structure prediction using Rosetta and SWISS modeling of LbCas12a comprising the mutations G532A, K538A, Y5442A and K595A in the wildtype sequence.

PI = PAM-interacting domain of the K595A variant
REC1 = REC1 domain of the K595A variant
WED = WED domain of the K595A variant Mutation 5, Combination G532A, K538A, Y542A, and K595A: The structure of an RNP comprising the combination G532A/K538A/Y542A/K595A variant ("combination variant") nucleic acid-guided nuclease is shown in FIG. 11E. Modeling indicated the following changes to the wildtype LbCas12a structure with the four substitutions: loss of five hydrogen bonds with TS-PAM (target strand PAM); loss of one hydrogen bond with NTS-PAM (non-target strand PAM). Per simulations, the combination variant is structurally stable. The parameters collected from SWISS-MODEL and Rosetta analysis are shown in Table 21.

TABLE 21

Mutation 5: G532A/K538A/Y542A/K595A
Global RMSD: 0.966
PI RMSD: 0.351
REC1 RMSD: 0.261 (226 to 226 atoms)
WED RMSD: 0.288 (200 to 200 atoms)
ΔΔG Flex Value: −3.31

Figure 11F:
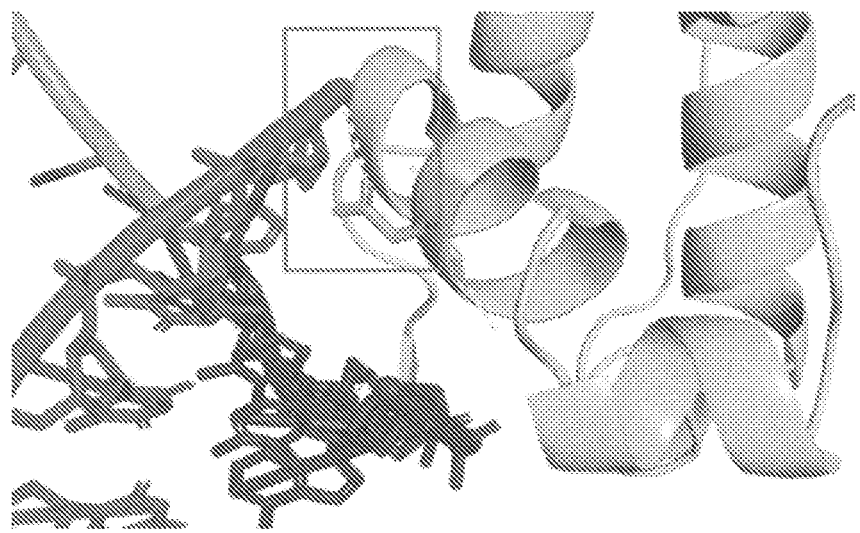
FIG. 11F shows the result of protein structure prediction using Rosetta and SWISS modeling of LbCas12a comprising the mutation K595D in the wildtype sequence.

PI = PAM-interacting domain of the combination variant
REC1 = REC1 domain of the combination variant
WED = WED domain of the combination variant Mutation 6, K595D: The structure of an RNP comprising the K595D variant nucleic acid-guided nuclease is shown in FIG. 11F. Modeling indicated the following changes to the wildtype LbCas12a structure at location 595 with this substitution: loss of two hydrogen bonds with TS-PAM (target strand PAM); loss of one hydrogen bond with NTS-PAM (non-target strand PAM); and gain of one hydrogen bond with NTS-PAM. Per simulations, the K595D variant is structurally unstable. The parameters collected from SWISS-MODEL and Rosetta analysis are shown in Table 22.

TABLE 22

Mutation 6: K595D
Global RMSD: 1.001
PI RMSD: 0.367 (89 to 89 atoms)
REC1 RMSD: 0.296 (235 to 235 atoms)
WED RMSD: 0.320 (197 to 197 atoms)
ΔΔG Flex Value: 2.04

Figure 11G:
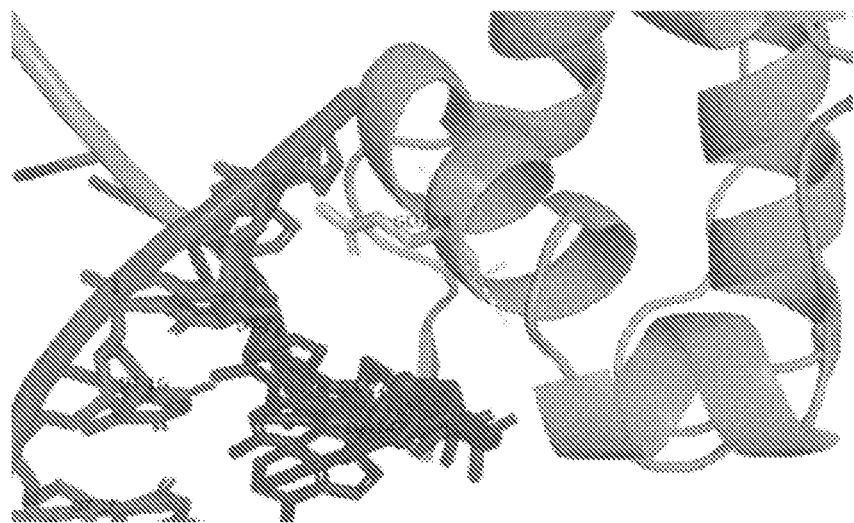
FIG. 11G shows the result of protein structure prediction using Rosetta and SWISS modeling of LbCas12a comprising the mutation K595E in the wildtype sequence.

PI = PAM-interacting domain of the combination variant
REC1 = REC1 domain of the combination variant
WED = WED domain of the combination variant Mutation 7, K595E: The structure of an RNP comprising the K595E variant nucleic acid-guided nuclease is shown in FIG. 11G. Modeling indicated the following changes to the wildtype LbCas12a structure at location 595 with this substitution: loss of two hydrogen bonds with TS-PAM (target strand PAM); loss of one hydrogen bond with NTS; and no gain of hydrogen bonds. Per simulations, the K595E variant is structurally unstable. The parameters collected from SWISS-MODEL and Rosetta analysis are shown in Table 23.

TABLE 23

Mutation 6: K595E
Global RMSD: 0.975
PI RMSD: 0.352 (89 to 89 atoms)
REC1 RMSD: 0.264 (226 to 226 atoms)
WED RMSD: 0.290 (198 to 198 atoms)
ΔΔG Flex Value: 1.37

Figure 11H:
FIG. 11H shows the result of protein structure prediction using Rosetta and SWISS modeling of LbCas12a comprising the mutations K538A, Y542A and K595D in the wildtype sequence.

PI = PAM-interacting domain of the combination variant
REC1 = REC1 domain of the combination variant
WED = WED domain of the combination variant Mutation 8, Combination K538A, Y542A, K595D: The structure of an RNP comprising the combination K538A/Y542A/K595D variant ("combination variant") nucleic acid-guided nuclease is shown in FIG. 11H. Modeling indicated the following changes to the wildtype LbCas12a structure with the three substitutions: loss of two hydrogen bonds with TS (target strand) at position 595; loss of one hydrogen bond with NTS (non-target); combined loss of three hydrogen bonds at 532/242 positions; and gain of one hydrogen bond at 595. Per simulations, the combination variant is structurally destabilizing. The parameters collected from SWISS-MODEL and Rosetta analysis are shown in Table 24.

TABLE 24

Mutation 6: K538A, Y542A, K595D
Global RMSD: 0.976
PI RMSD: 0.351 (89 to 89 atoms)
REC1 RMSD: 0.261 (225 to 225 atoms)
WED RMSD: 0.289 (198 to 198 atoms)
ΔΔG Flex Value: 0.96

Figure 11I:
FIG. 11I shows the result of protein structure prediction using Rosetta and SWISS modeling of LbCas12a comprising the mutations K538A, Y542A and K595E in the wildtype sequence.
Figure 12A:
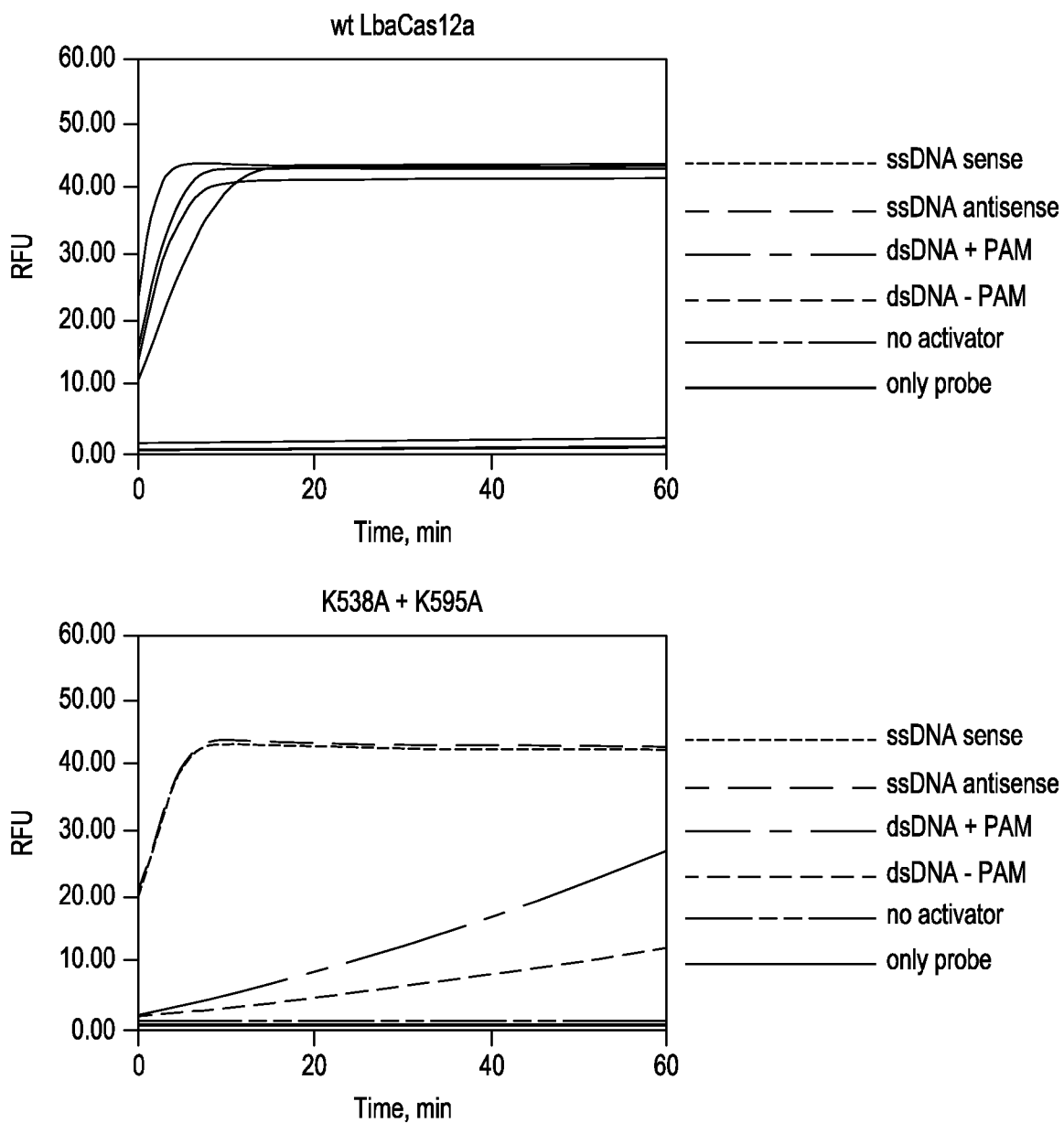
Figure 12B:
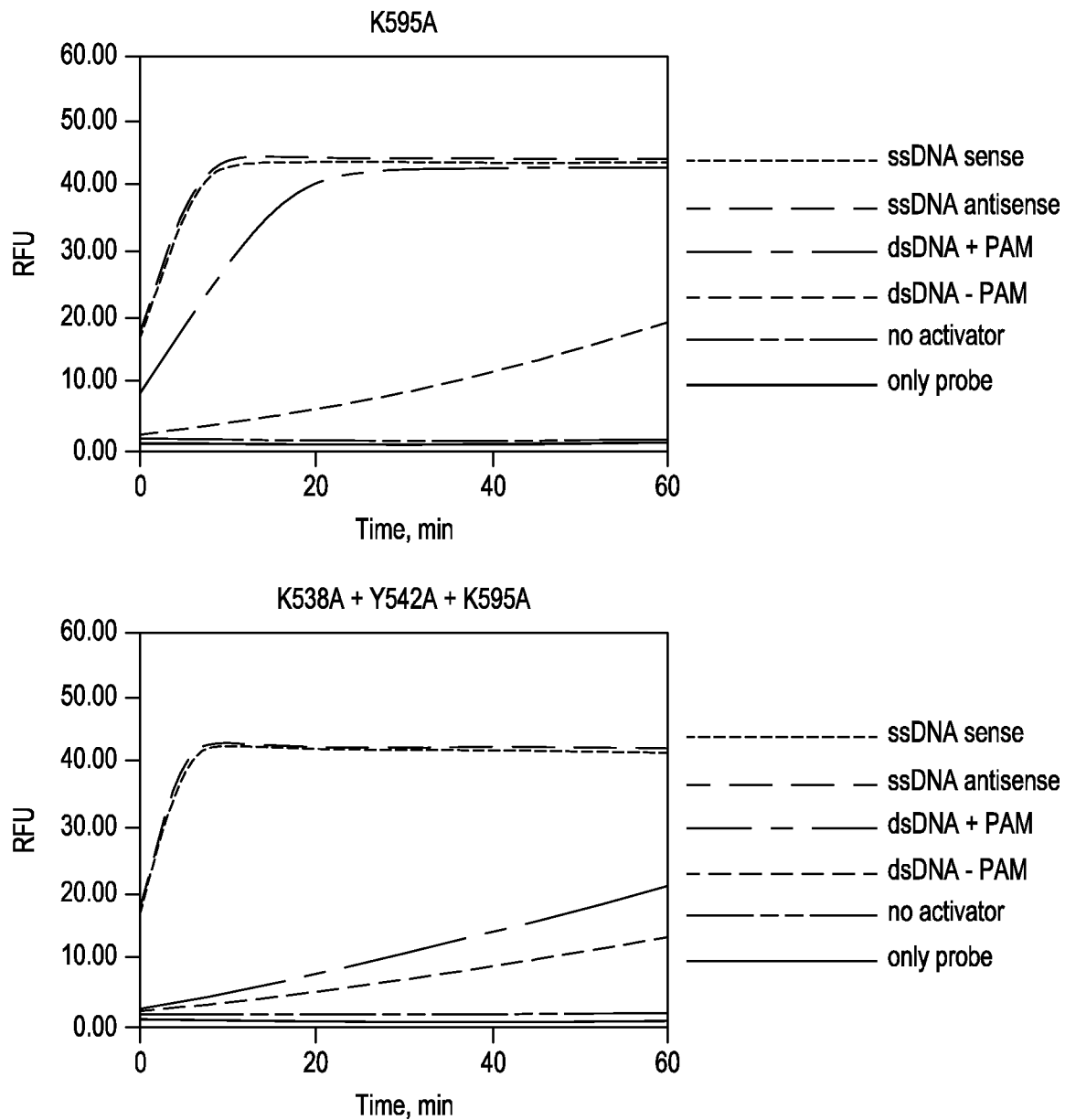
Figure 12C:
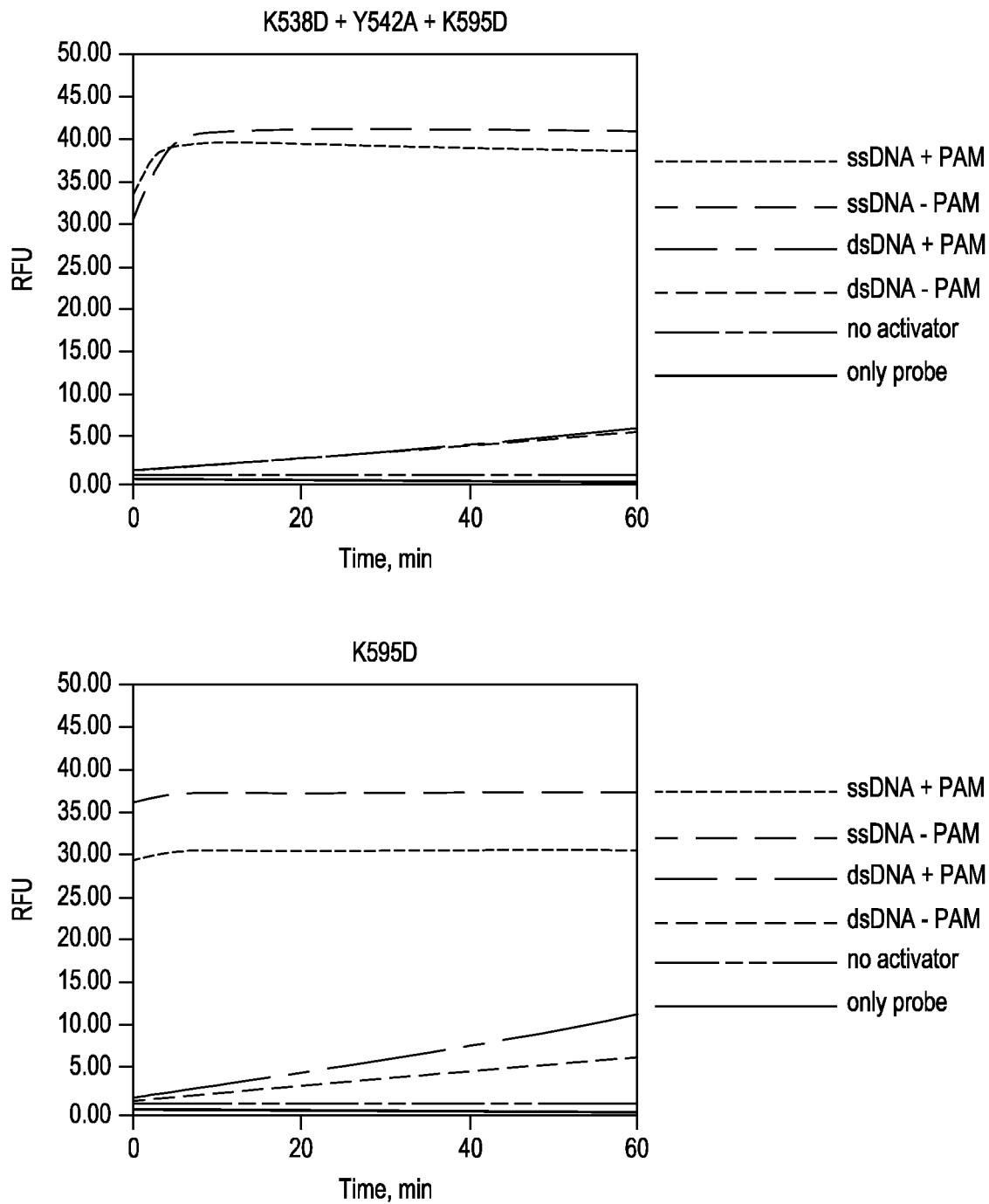
Figure 12G:
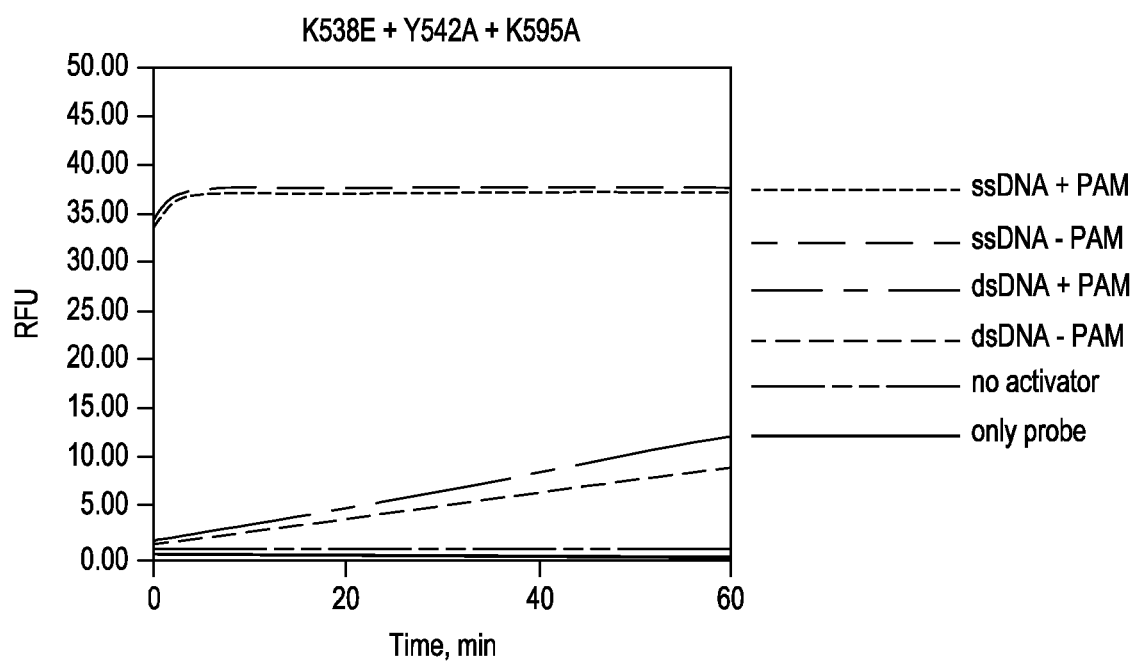

PI = PAM-interacting domain of the combination variant
REC1 = REC1 domain of the combination variant
WED = WED domain of the combination variant Mutation 9, Combination K538A, Y542A, K595E: The structure of an RNP comprising the combination K538A/Y542A/K595E variant ("combination variant") nucleic acid-guided nuclease is shown in FIG. 11I. Modeling indicated the following changes to the wildtype LbCas12a structure with the three substitutions: loss of two hydrogen bonds with TS (target strand) at position 595; loss of one hydrogen bond with NTS (non-target); combined loss of three hydrogen bonds at 532/242 positions. Per simulations, the combination variant is structurally stabilizing. The parameters collected from SWISS-MODEL and Rosetta analysis are shown in Table 25.

TABLE 25

Mutation 6: K538A, Y542A, K595E
Global RMSD: 0.976
PI RMSD: 0.351 (89 to 89 atoms)
REC1 RMSD: 0.261 (225 to 225 atoms)
WED RMSD: 0.289 (198 to 198 atoms)
ΔΔG Flex Value: −3.71

PI = PAM-interacting domain of the combination variant
REC1 = REC1 domain of the combination variant
WED = WED domain of the combination variant In addition to amino acid substitutions, modifications, such as chemical modifications, can be made to amino acids identified by the structural and homology modeling described above. FIG. 6G illustrates an exemplary scheme for acetylating amino acid residue 595 in LbCas12a, a modification which prevents unwinding of dsDNA by blocking entry of a target nucleic acid into the RNP via steric hindrance. LbCas12a is combined with AcrVA5 and the reaction is incubated for 20 minutes at room temperature, resulting in LECas12a that has been acetylated at amino acid residue 595 (K595K$^{AC}$). (For a discussion and methods for disabling of Cas12a by ArVA5, see Dong, et al., Nature Structural and Molecular Bio., 26(4):308-14 (2019).) DsDNA is not a substrate for LbCas12a with a K595K$^{AC}$ modification; however, ssDNA is a substrate for LbCas12a with a K595K$^{AC}$ modification; thus, LbCas12a (K595K$^{AC}$) has the desired properties of the variant nucleic acid-guided

Example VIII: Single-Strand Specificity of the Variant Nucleic Acid-Guided Nucleases In vitro transcription/translation reactions were performed for variant LbaCas12a nucleases as noted in Table 26 using the nucleic acid sequences listed in Table 27:

TABLE 26

| | |
|---|---|
| Template DNA for IVTT | 250 ng |
| gRNA concentration | 100 nM |
| DNA activator concentration | 25 nM |
| Probe concentration | 500 nM |
| Reaction volume | 30 μL |
| Reporter | 5'-FAM-TTATTATT-IABkFQ-3' |
| Plate | PCR plate 96-well, black |
| Read temperature | 25° C. |
| Read duration | 30 minutes |
| Buffer | NEB r2.1 New England Biolabs ®, Inc., Ipswich, MA) |
| Na+ | 50 mM |
| Mg+2 | 10 mM |

TABLE 27

| Activator | |
|---|---|
| RunX fragment (dsDNA + PAM) | GCCTTCAGAAGAGGGTGCATTTTCAGGAGGAA GCGATGGCTTCAGACAGCATATTTGAGTCATT (SEQ ID NO. 617) |
| RunX fragment (dsDNA − PAM) | GCCTTCAGAAGAGGGTGCATGCACAGGAGGAA GCGATGGCTTCAGACAGCATATTTGAGTCATT (SEQ ID NO. 618) |
| Target region in activator | AGGAGGAAGCGATGGCTTCAGA (SEQ ID NO. 619) |
| gRNA | |
| LbaCas12a gRNA | gUAAUUUCUACUAAGUGUAGAUAGGAGGAAG CGAUGGCUUCAGA (SEQ ID NO. 620) |

The results are shown in FIGS. 12A-12G indicating the time for detection of dsDNA and ssDNA both with and without PAM sequences for purified wildtype LbaCas12a and three variants (K538A+K595A, K595A, and K538A+Y542+K595A, and unpurified engineered variants of LbaCas12a: K538D+Y542A+K595D, K595D, K538A+K595D, K538A+K595E, G532A+K538A+Y542A+K595A, K538A+Y542A+K595D, K538D+Y542A+K595A, K538D+Y542D+K595A, and K538E+Y542A+K595A. Note that all variant engineered nucleic acid-guided nucleases slowed down double-strand DNA detection to varying degrees, with the double and triple variants at positions K538, Y542 and K595 of wt LbaCas12a performing best in comparison to wt LbCas12a, while single-strand DNA detection remained high, both in single-strand DNA with a PAM and without a PAM. The following variants were particularly robust: K538D+Y542A+K595D, K538A+K595D, K538A+K595E, G532A+K538A+Y542A+K595A, K538D+Y542A+K595A, and K538D+Y542D+K595D.

FIGS. 13A and 13B show the sequence alignment of many different Cas12a nucleases and orthologs, including in some instances several alignments of the same Cas12a nuclease.

Example IX: Detection of Biomarker Alpha-Synuclein in CSF for Monitoring Progression of Parkinson's Disease The biomarker α-synuclein, which is found in both aggregated and fibrillar form, has attracted attention as a biomarker of Parkinson's disease. Human α-synuclein is expressed in the brain in the neocortex, hippocampus, substantia nigra, thalamus and cerebellum. It is encoded by the SNCA gene that consists of six exons ranging in size from 42 to 1110 base pairs. The predominant form of α-synuclein is the full-length protein, but other shorter isoforms exist. C-terminal truncation of α-synuclein induces aggregation, suggesting that C-terminal modifications may be involved in Parkinson's pathology. Changes in the levels of α-synuclein have been reported in CSF of Parkinson' patients. The gradual spread of α-synuclein pathology leads to a high concentration of extracellular α-synuclein that can potentially damage healthy neurons. Here, the cascade assay is used to monitor the level of nucleic acids in cerebrospinal fluid (CSF) to monitor the levels of mRNA transcripts that when translated lead to a truncated α-synuclein protein.

A lumbar puncture is performed on an individual, withdrawing approximately 5 mL of cerebrospinal fluid (CSF) for testing. The CSF sample is then treated by phenol-chloroform extraction or oligo dT affinity resins via a commercial kit (see, e.g., the TurboCapture mRNA kit or RNeaxy Pure mRNA Bead Kit from Qiagen®). Briefly, two RNP1s are preassembled as described above in Example II with a first gRNA sequence designed to target the coding sequence of the mRNA transcribed from SNCA gene specific to the C-terminus region of α-synuclein to detect full-length α-synuclein and second gRNA sequence designed to target the coding sequence of the mRNA transcribed from SNCA gene specific to the N-terminus region of α-synuclein to detect all α-synuclein mRNAs. In addition to the gRNA, each RNP1 also comprises an LbCas13a nuclease (i.e., an RNA-specific nuclease). Also as described in Example II above, an RNP2 is preassembled with a gRNA sequence designed to target an unblocked nucleic acid molecule that results from unblocking (i.e., linearizing) a chosen blocked nucleic acid molecule such as U29. The blocked nucleic acid molecule is formed as described above in Example III, and a reporter is formed as described above in Example IV. The reaction mix contains the preassembled RNP1, preassembled RNP2, and a blocked nucleic acid molecule, in a buffer (pH of about 8) containing 4 mM $MgCl_2$ and 101 mM NaCl. The cascade assay is performed by one of the protocols described above in Example V. A readout is performed by comparing the level of N-terminus coding sequences detected (the level of total α-synuclein mRNA) versus the level of C-terminus coding sequences detected (the level of full-length α-synuclein mRNA).

Example X: Detection of Foot and Mouth Disease Virus from Nasal Swabs

Foot-and-mouth disease (FMD) is a severe and highly contagious viral disease. The FMD virus causes illness in cows, pigs, sheep, goats, deer, and other animals with divided hooves and is a worldwide concern as it can spread quickly and cause significant economic losses. FMD has serious impacts on the livestock trade a single detection of FMD will stop international trade completely for a period of time. Since the disease can spread widely and rapidly and has grave economic consequences, FMD is one of the animal diseases livestock owners dread most. FMD is caused by a virus, which survives in living tissue and in the breath, saliva, urine, and other excretions of infected animals. FMD can also survive in contaminated materials and the environment for several months under the right conditions.

A nasal swab is performed on a subject, such as a cow or pig, and the nucleic acids extracted using, e.g., the Monarch Total RNA Miniprep Kit (New England Biolabs®, Inc., Ipswich, MA). Briefly, an RNP1 is preassembled as described above in Example II with a gRNA sequence designed to a gene from the FMD virus (e.g., to a portion of NCBI Reference Sequence NC_039210.1) and an LbCas12a nuclease (i.e., a DNA-specific nuclease). Also as described in Example II above, an RNP2 is preassembled with a gRNA sequence designed to target an unblocked nucleic acid molecule that results from unblocking (i.e., linearizing) a chosen blocked nucleic acid molecule such as U29. The blocked nucleic acid molecule is formed as described above in Example III, and a reporter is formed as described above in Example IV. The reaction mix contains the preassembled RNP1, preassembled RNP2, and a blocked nucleic acid molecule, in a buffer (pH of about 8) containing 4 mM $MgCl_2$ and 101 mM NaCl. The cascade assay is performed by one of the protocols described above in Example V, and the readout is positive detection of FMD virus-specific DNA sequences.

Example XI: Detection of Sickle Cell Gene Sequences in Peripheral Blood

Sickle cell disease (SCD) is a group of inherited red blood cell disorders. In someone who has SCD, the hemoglobin is abnormal, which causes the red blood cells to become hard and sticky and look like a C-shaped farm tool called a "sickle." The sickle cells die early, which causes a constant shortage of red blood cells; in addition, when the sickle-shaped blood cells travel through small blood vessels, they get stuck and clog the blood flow, causing pain and other serious complications such as infection and stroke.

One form of SCD is HbSS. Individuals who have this form of SCD inherit two genes, one from each parent, that code for hemoglobin "S." Hemoglobin S is an abnormal form of hemoglobin that causes the red cells to become rigid and sickle shaped. This is commonly called sickle cell anemia and is usually the most severe form of the disease. Another form of SCD is HbSC. Individuals who have this form of SCD inherit a hemoglobin "S" gene from one parent and a gene for a different type of abnormal hemoglobin called "C" from the other parent. This is usually a milder form of SCD. A third form of SCD is HbS thalassemia. Individuals who have this form of SCD inherit a hemoglobin "S" gene from one parent and a gene for beta thalassemia, another type of hemoglobin abnormality, from the other parent. There are two types of beta thalassemia: "zero" (HbS beta0) and "plus" (HbS beta+). Those with HbS beta0-thalassemia usually have a severe form of SCD. People with HbS beta+-thalassemia tend to have a milder form of SCD.

A non-invasive prenatal test (NIPT) that uses only maternal cell-free DNA (cfDNA) from peripheral blood permits prenatal detection of sickle cell disease and beta thalassemia by screening without the need for paternal DNA. Such a screening enables patients and healthcare providers to make informed decisions about diagnostic testing and may expand gene therapy treatment options. A 10 mL peripheral blood draw is performed on a pregnant subject into a Streck tube. The blood is treated with lysis-binding buffer and proteinase K under denaturing conditions at 55° C. for 15 minutes in the presence of magnetic beads. Following the heating step, the mixture is incubated for 1 hour at room temperature with mixing every 10 minutes at 1200 rpm for 30 seconds on an Eppendorf themomixer. The beads are captured on a magnetic stand for 2 minutes, washed three times after which cfDNA is eluted by adding elution buffer and incubating for 5 minutes at 55° C. The cfDNA is further purified by diluting in 1:1 FTA (Fast Technology for Analysis) reagent, cat #WHAWB120204 (Sigma-Aldrich, USA), containing NaCl (sodium chloride); Tris; EDTA (ethylenediaminetetraacetic acid); TRITON-X-100 (t-Octylphenoxypolyethoxyethanol) and incubated for 10 minutes at room temperature. An additional bead purification step is performed using PCR-Clean DX beads, cat #C-1003-450 (ALINE Biosciences, USA). Alternatively, there are several kits available commercially that are designed to extract cfDNA including the BioChain® cfPure® Cell free DNA Extraction Kit (BioChain®, Newark, CA); the Monarch Genomic DNA Purification Kit and the Monarch HMW DNA Extraction Kit for Blood (New England Biolabs®, Inc., Ipswich, MA); and the cfDNA Purification Kit (Active Motif®, Carlsbad, CA).

For the cascade assay, three RNP1s are preassembled as described above in Example II with 1) gRNA sequence designed to detect the Hemoglobin S gene variant and an LbCas12a nuclease (i.e., an DNA-specific nuclease); 2) a gRNA sequence designed to detect the Hemoglobin C gene variant and an LbCas 12a nuclease (i.e., an DNA-specific nuclease); and 3) a gRNA sequence designed to detect the gene for beta thalassemia and an LbCas12a nuclease (i.e., an DNA-specific nuclease). Also as described in Example II above, an RNP2 is preassembled with a gRNA sequence designed to target an unblocked nucleic acid molecule that results from unblocking (i.e., linearizing) a chosen blocked nucleic acid molecule such as U29. The blocked nucleic acid molecule is formed as described above in Example III, and a reporter is formed as described above in Example IV. The reaction mix contains the preassembled RNP1, preassembled RNP2, and a blocked nucleic acid molecule, in a buffer (pH of about 8) containing 4 mM $MgCl_2$ and 101 mM NaCl. The cascade assay is performed by one of the protocols described above in Example V. The readout is detection of the Hemoglobin S gene variant, the detection of the Hemoglobin S variant and the Hemoglobin C variant, and the detection of the Hemoglobin S variant and the β-thalassemia gene.

Example XII: Detection of Donor-Derived Gene Sequences in Peripheral Blood of Transplant Patients Costly and invasive tissue biopsies to detect allograft rejection after transplantation have numerous limitations; however, assays based on cell-free DNA (cfDNA) circulating fragments of DNA released from cells, tissues, and organs as they undergo natural cell death can improve the ability to detect rejection and implement earlier changes in management of the transplanted organ. Rejection, referring to injury of a donated organ caused by the recipient's immune system, often causes allograft dysfunction and even patient death. T-cell mediated acute cellular rejection occurs most often within the first 6 months post-transplant. Acute cellular rejection involves accumulation of CD4+ and CD8+ T-cells in the interstitial space of the allograft as the recipient's immune system recognizes antigens on the donated organ as foreign, initiating an immune cascade that ultimately leads to apoptosis of the targeted cells. As these cells die, genomic DNA is cleaved and fragments of donor derived-cfDNA are released to join the pool of recipient cfDNA in the blood. Using cfDNA as a biomarker for acute cellular rejection is advantageous since it is derived from the injured cells of the donated organ and therefore should represent a direct measure of cell death occurring in the allograft. Further, cfDNA maintains all of the genetic features of the original genomic DNA, allowing the genetic material released from the donated organ to be differentiated from the cfDNA derived from cells of the recipient that are undergoing natural apoptosis.

For organ transplants in which the donor is male and the recipient is female, this "sex mismatch" is leveraged to calculate donor derived-cfDNA levels from within the recipient's total cfDNA pool. Although this approach allows for confident diagnosis of rejection in the allograft, sex-mismatch between the donor and recipient is relatively infrequent and not universally applicable; thus, the presence of other genetic differences between the donor and recipient at a particular locus are leveraged to identify the origin of the circulating cfDNA. Ideally, the recipient would be homozygous for a single base (for example, AA) and at the same locus the donor would be homozygous for a different base (for example, GG). Given the genetic heterogeneity between individuals, hundreds to tens of thousands of potentially informative loci across the genome can be interrogated to distinguish donor derived-cfDNA from recipient cfDNA.

A 10 mL peripheral blood draw is performed on a transplantation subject into a Streck tube. The blood is treated with lysis-binding buffer and proteinase K under denaturing conditions at 55° C. for 15 minutes in the presence of magnetic beads. Following the heating step, the mixture is incubated for 1 hour at room temperature with mixing every 10 minutes at 1200 rpm for 30 seconds on an Eppendorf themomixer. The beads are captured on a magnetic stand for 2 minutes, washed three times after which cfDNA is eluted by adding elution buffer and incubating for 5 minutes at 55° C. The cfDNA is further purified by diluting in 1:1 FTA (Fast Technology for Analysis) reagent, cat #WHAWB120204 (Sigma-Aldrich, USA), containing NaCl (sodium chloride); Tris; EDTA (ethylenediaminetetraacetic acid); TRITON-X-100 (t-Octylphenoxypolyethoxyethanol) and incubated for 10 minutes at room temperature. An additional bead purification step is performed using PCR-Clean DX beads, cat #C-1003-450 (ALINE Biosciences, USA). Also, as stated above, there are several kits available commercially that are designed to extract cfDNA including the BioChain® cfPure® Cell free DNA Extraction Kit (BioChain®, Newark, CA); the Monarch Genomic DNA Purification Kit and the Monarch HMW DNA Extraction Kit for Blood (New England Biolabs®, Inc., Ipswich, MA); and the cfDNA Purification Kit (Active Motif®, Carlsbad, CA).

For the cascade assay, several to many different RNP1s are preassembled as described above in Example II with gRNA sequences designed to 1) query Y and/or X chromosome loci in sex mismatch transplantation cases; or 2) gRNA sequences designed to query various loci that are different in the genomic DNA of the recipient and the donor; along with an LbCas12a nuclease (i.e., an DNA-specific nuclease). Also as described in Example II above, an RNP2 is preassembled with a gRNA sequence designed to target an unblocked nucleic acid molecule that results from unblocking (i.e., linearizing) a chosen blocked nucleic acid molecule such as U29. The blocked nucleic acid molecule is formed as described above in Example III, and a reporter is formed as described above in Example IV. The reaction mix contains the preassembled RNP1, preassembled RNP2, and a blocked nucleic acid molecule, in a buffer (pH of about 8) containing 4 mM $MgCl_2$ and 101 mM NaCl. The cascade assay is performed by one of the protocols described above in Example V. The readout detects the level of donor-specific nucleic acid sequences.

Example XIII: Detection of Microbe Contamination in a Laboratory

DNA that is found in the environment is called "environmental DNA" or eDNA (e-DNA) for short, and it is formally defined as "genetic material obtained directly from environmental samples without any obvious signs of biological source material." eDNA has been harnessed to detect rare or invasive species and pathogens in a broad range of environments. Samples are typically collected in the form of water, soil, sediment, or surface swabs. The DNA must then be extracted and purified to remove chemicals that may inhibit the cascade reaction. Surface wipe samples are commonly collected to assess microbe contamination in, e.g., a laboratory. The wipe test protocol consists of four distinct stages: removal of DNA from surfaces using absorbent wipes, extraction of DNA from the wipes into a buffer solution, purification of DNA, and analysis of the extract.

For sample collection, sterile 2×2 inch polyester-rayon non-woven wipes are used to wipe down an environmental surface, such as a laboratory bench. Each wipe is placed into a sterile 50 ml conical tube and 10 mL of PBST is transferred to each conical tube using a sterile serological pipette. The tubes are vortexed at the maximum speed for 20 minutes using a Vortex Genie 2. A 200 µL aliquot of the supernatant was processed using a nucleic acid purification kit (QIAmp DNA Blood Mini Kit, QIAGEN, Inc., Valencia, CA). The kit lyses the sample, stabilizes and binds DNA to a selective membrane, and elutes the DNA sample.

For the cascade assay, several to many different RNP1s are preassembled as described above in Example II with gRNA sequences designed to detect, e.g., *Aspergillus acidus*; Parafilaria bovicola; Babesia divergens; *Escherichia coli; Pseudomonas aeruginosa*; and Dengue virus; along with an LbCas12a nuclease (i.e., an DNA-specific nuclease). Also as described in Example II above, an RNP2 is preassembled with a gRNA sequence designed to target an unblocked nucleic acid molecule that results from unblocking (i.e., linearizing) a chosen blocked nucleic acid molecule such as U29. The blocked nucleic acid molecule is formed as described above in Example III, and a reporter is formed as described above in Example IV. The reaction mix contains the preassembled RNP1, preassembled RNP2, and a blocked nucleic acid molecule, in a buffer (pH of about 8) containing 4 mM $MgCl_2$ and 101 mM NaCl. The cascade assay is performed by one of the protocols described above in Example V. The readout is detection of a genomic sequence unique to a pathogen.

While certain embodiments have been described, these embodiments have been presented by way of example only and are not intended to limit the scope of the present disclosures. Indeed, the novel methods, apparatuses, modules, instruments and systems described herein can be embodied in a variety of other forms; furthermore, various omissions, substitutions and changes in the form of the methods, apparatuses, modules, instruments and systems described herein can be made without departing from the spirit of the present disclosures. The accompanying claims and their equivalents are intended to cover such forms or modifications as would fall within the scope and spirit of the present disclosures.

SEQUENCE LISTING (620 sequences)

SEQ ID NO: 1 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 3 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNKVYDYASLIFLRDGNYYLGIINPKRKKNIKFEQGSGNGPFYRKMVYKQIPGPNKNLPRVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 4 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSKEFDNNAIILIRDNKYYLAIFNAKNKPDKKIIQGNSDKKNDNDYKKMVYNLLPGANKMLPKVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 5 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNKEKDNFGVILQKDGCYYLALLDKAHKKVFDNAPNTGKSVYQKMIYKLLPGPNKMLPKVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 6 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 7 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNKESANTAILFIKDDKYYLGIMDKKHNKIFSDKAIEENKGEGYKKIVYKQIADASKDIQNLMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 8 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNKETDNTSVILRKDGLYYLAIMPQDNKNVFKDSPDLKANENCFEKMDYKQMALPMGFGAFVRKCFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 9 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSKEFDNNAIILIRDNKYYLAIFNAKNKPDKKIIQGNSDKKNDNDYKKMVYNLLPGANKMLPKVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 10 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKNVYQKMVYKLLPGPNKMLPKVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 11 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNKEHDNTAIILRKNGLYYLAIMKKSANKIFDKDKLDNSGDCYEKMVYKLLPGANKMLPKVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 12 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSKEKDNLGLIFIKNNKYYLGVLRKENSKLFDYQITEKDNQKEKERKNNLKNEILANDNEDFYLKMNYWQIADPAKDIFNLVLMPDNTVKRFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 13 - protein, 1307 aa, Acidaminococcus sp.; identical to SEQ ID NO: 2

SEQ ID NO: 14 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNKEIDNTSVILRKRGLYYLAIMPQDNKNVFKKSPNLKNNESCFEKMDYKQMALPMGFGAFVRKCFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 15 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNKERDNKAAILRKDGKYYLAILDMKKDLSSIRTSDEDESSFEKMEYKLLPSPVKMLPKIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 16 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPAVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 17 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPDVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 18 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPEVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 19 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDAETDYRATILRYGSKYYLAIMDKKYAKCLQKIDKDDVNGNYEKINYKLLPGPNKMLPAVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 20 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDAETDYRATILRYGSKYYLAIMDKKYAKCLQKIDKDDVNGNYEKINYKLLPGPNKMLPDVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 21 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDAETDYRATILRYGSKYYLAIMDKKYAKCLQKIDKDDVNGNYEKINYKLLPGPNKMLPEVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 22 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDDETDYRATILRYGSKYYLAIMDKKYAKCLQKIDKDDVNGNYEKINYKLLPGPNKMLPAVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 23 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDDETDYRATILRYGSKYYLAIMDKKYAKCLQKIDKDDVNGNYEKINYKLLPGPNKMLPDVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 24 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDDETDYRATILRYGSKYYLAIMDKKYAKCLQKIDKDDVNGNYEKINYKLLPGPNKMLPEVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 25 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDEETDYRATILRYGSKYYLAIMDKKYAKCLQKIDKDDVNGNYEKINYKLLPGPNKMLPAVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 26 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDEETDYRATILRYGSKYYLAIMDKKYAKCLQKIDKDDVNGNYEKINYKLLPGPNKMLPDVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 27 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDEETDYRATILRYGSKYYLAIMDKKYAKCLQKIDKDDVNGNYEKINYKLLPGPNKMLPEVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 28 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDAETDARATILRYGSKYYLAIMDKKYAKCLQKIDKDDVNGNYEKINYKLLPGPNKMLPAVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 29 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDAETDDRATILRYGSKYYLAIMDKKYAKCLQKIDKDDVNGNYEKINYKLLPGPNKMLPAVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 30 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDAETDERATILRYGSKYYLAIMDKKYAKCLQKIDKDDVNGNYEKINYKLLPGPNKMLPAVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 31 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDAETDARATILRYGSKYYLAIMDKKYAKCLQKIDKDDVNGNYEKINYKLLPGPNKMLPDVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 32 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDAETDDRATILRYGSKYYLAIMDKKYAKCLQKIDKDDVNGNYEKINYKLLPGPNKMLPDVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 33 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDAETDERATILRYGSKYYLAIMDKKYAKCLQKIDKDDVNGNYEKINYKLLPGPNKMLPDVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 34 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDAETDARATILRYGSKYYLAIMDKKYAKCLQKIDKDDVNGNYEKINYKLLPGPNKMLPEVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 35 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDAETDDRATILRYGSKYYLAIMDKKYAKCLQKIDKDDVNGNYEKINYKLLPGPNKMLPEVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 36 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDAETDERATILRYGSKYYLAIMDKKYAKCLQKIDKDDVNGNYEKINYKLLPGPNKMLPEVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 37 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDDETDARATILRYGSKYYLAIMDKKYAKCLQKIDKDDVNGNYEKINYKLLPGPNKMLPAVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 38 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDDETDDRATILRYGSKYYLAIMDKKYAKCLQKIDKDDVNGNYEKINYKLLPGPNKMLPAVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 39 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDDETDERATILRYGSKYYLAIMDKKYAKCLQKIDKDDVNGNYEKINYKLLPGPNKMLPAVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 40 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDDETDARATILRYGSKYYLAIMDKKYAKCLQKIDKDDVNGNYEKINYKLLPGPNKMLPDVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 41 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDDETDDRATILRYGSKYYLAIMDKKYAKCLQKIDKDDVNGNYEKINYKLLPGPNKMLPDVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 42 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDDETDERATILRYGSKYYLAIMDKKYAKCLQKIDKDDVNGNYEKINYKLLPGPNKMLPDVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 43 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDDETDARATILRYGSKYYLAIMDKKYAKCLQKIDKDDVNGNYEKINYKLLPGPNKMLPEVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 44 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDDETDDRATILRYGSKYYLAIMDKKYAKCLQKIDKDDVNGNYEKINYKLLPGPNKMLPEVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 45 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDDETDERATILRYGSKYYLAIMDKKYAKCLQKIDKDDVNGNYEKINYKLLPGPNKMLPEVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 46 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDEETDARATILRYGSKYYLAIMDKKYAKCLQKIDKDDVNGNYEKINYKLLPGPNKMLPAVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 47 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDEETDDRATILRYGSKYYLAIMDKKYAKCLQKIDKDDVNGNYEKINYKLLPGPNKMLPAVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 48 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDEETDERATILRYGSKYYLAIMDKKYAKCLQKIDKDDVNGNYEKINYKLLPGPNKMLPAVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 49 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDEETDARATILRYGSKYYLAIMDKKYAKCLQKIDKDDVNGNYEKINYKLLPGPNKMLPDVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 50 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDEETDDRATILRYGSKYYLAIMDKKYAKCLQKIDKDDVNGNYEKINYKLLPGPNKMLPDVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 51 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDEETDERATILRYGSKYYLAIMDKKYAKCLQKIDKDDVNGNYEKINYKLLPGPNKMLPDVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 52 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDEETDARATILRYGSKYYLAIMDKKYAKCLQKIDKDDVNGNYEKINYKLLPGPNKMLPEVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 53 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDEETDDRATILRYGSKYYLAIMDKKYAKCLQKIDKDDVNGNYEKINYKLLPGPNKMLPEVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 54 - protein, 1228 aa, Lachnospira sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDEETDERATILRYGSKYYLAIMDKKYAKCLQKIDKDDVNGNYEKINYKLLPGPNKMLPEVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 55 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPACSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 56 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPDCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 57 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPECSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 58 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNAEKNNGAILFVKNGLYYLGIMPKQKGRYKALSFEPTEKTSEGFDKMYYDYFPDAAKMIPACSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 59 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNAEKNNGAILFVKNGLYYLGIMPKQKGRYKALSFEPTEKTSEGFDKMYYDYFPDAAKMIPDCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 60 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNAEKNNGAILFVKNGLYYLGIMPKQKGRYKALSFEPTEKTSEGFDKMYYDYFPDAAKMIPECSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 61 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNDEKNNGAILFVKNGLYYLGIMPKQKGRYKALSFEPTEKTSEGFDKMYYDYFPDAAKMIPACSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 62 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNDEKNNGAILFVKNGLYYLGIMPKQKGRYKALSFEPTEKTSEGFDKMYYDYFPDAAKMIPDCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 63 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNDEKNNGAILFVKNGLYYLGIMPKQKGRYKALSFEPTEKTSEGFDKMYYDYFPDAAKMIPECSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 64 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNEEKNNGAILFVKNGLYYLGIMPKQKGRYKALSFEPTEKTSEGFDKMYYDYFPDAAKMIPACSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 65 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNEEKNNGAILFVKNGLYYLGIMPKQKGRYKALSFEPTEKTSEGFDKMYYDYFPDAAKMIPDCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 66 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNEEKNNGAILFVKNGLYYLGIMPKQKGRYKALSFEPTEKTSEGFDKMYYDYFPDAAKMIPECSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 67 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNAEKNAGAILFVKNGLYYLGIMPKQKGRYKALSFEPTEKTSEGFDKMYYDYFPDAAKMIPACSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 68 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNAEKNDGAILFVKNGLYYLGIMPKQKGRYKALSFEPTEKTSEGFDKMYYDYFPDAAKMIPACSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 69 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNAEKNEGAILFVKNGLYYLGIMPKQKGRYKALSFEPTEKTSEGFDKMYYDYFPDAAKMIPACSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 70 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNAEKNAGAILFVKNGLYYLGIMPKQKGRYKALSFEPTEKTSEGFDKMYYDYFPDAAKMIPDCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 71 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNAEKNDGAILFVKNGLYYLGIMPKQKGRYKALSFEPTEKTSEGFDKMYYDYFPDAAKMIPDCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 72 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNAEKNEGAILFVKNGLYYLGIMPKQKGRYKALSFEPTEKTSEGFDKMYYDYFPDAAKMIPDCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 73 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNAEKNAGAILFVKNGLYYLGIMPKQKGRYKALSFEPTEKTSEGFDKMYYDYFPDAAKMIPECSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 74 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNAEKNDGAILFVKNGLYYLGIMPKQKGRYKALSFEPTEKTSEGFDKMYYDYFPDAAKMIPECSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 75 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNAEKNEGAILFVKNGLYYLGIMPKQKGRYKALSFEPTEKTSEGFDKMYYDYFPDAAKMIPECSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 76 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNDEKNAGAILFVKNGLYYLGIMPKQKGRYKALSFEPTEKTSEGFDKMYYDYFPDAAKMIPACSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 77 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNDEKNDGAILFVKNGLYYLGIMPKQKGRYKALSFEPTEKTSEGFDKMYYDYFPDAAKMIPACSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 78 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNDEKNEGAILFVKNGLYYLGIMPKQKGRYKALSFEPTEKTSEGFDKMYYDYFPDAAKMIPACSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 79 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNDEKNAGAILFVKNGLYYLGIMPKQKGRYKALSFEPTEKTSEGFDKMYYDYFPDAAKMIPDCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 80 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNDEKNDGAILFVKNGLYYLGIMPKQKGRYKALSFEPTEKTSEGFDKMYYDYFPDAAKMIPDCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 81 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNDEKNEGAILFVKNGLYYLGIMPKQKGRYKALSFEPTEKTSEGFDKMYYDYFPDAAKMIPDCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 82 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNDEKNAGAILFVKNGLYYLGIMPKQKGRYKALSFEPTEKTSEGFDKMYYDYFPDAAKMIPECSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 83 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNDEKNDGAILFVKNGLYYLGIMPKQKGRYKALSFEPTEKTSEGFDKMYYDYFPDAAKMIPECSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 84 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNDEKNEGAILFVKNGLYYLGIMPKQKGRYKALSFEPTEKTSEGFDKMYYDYFPDAAKMIPECSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 85 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNEEKNAGAILFVKNGLYYLGIMPKQKGRYKALSFEPTEKTSEGFDKMYYDYFPDAAKMIPACSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 86 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNEEKNDGAILFVKNGLYYLGIMPKQKGRYKALSFEPTEKTSEGFDKMYYDYFPDAAKMIPACSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 87 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNEEKNEGAILFVKNGLYYLGIMPKQKGRYKALSFEPTEKTSEGFDKMYYDYFPDAAKMIPACSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 88 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNEEKNAGAILFVKNGLYYLGIMPKQKGRYKALSFEPTEKTSEGFDKMYYDYFPDAAKMIPDCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 89 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNEEKNDGAILFVKNGLYYLGIMPKQKGRYKALSFEPTEKTSEGFDKMYYDYFPDAAKMIPDCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 90 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNEEKNEGAILFVKNGLYYLGIMPKQKGRYKALSFEPTEKTSEGFDKMYYDYFPDAAKMIPDCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 91 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNEEKNAGAILFVKNGLYYLGIMPKQKGRYKALSFEPTEKTSEGFDKMYYDYFPDAAKMIPECSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 92 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNEEKNDGAILFVKNGLYYLGIMPKQKGRYKALSFEPTEKTSEGFDKMYYDYFPDAAKMIPECSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 93 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNEEKNEGAILFVKNGLYYLGIMPKQKGRYKALSFEPTEKTSEGFDKMYYDYFPDAAKMIPECSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 94 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNKVYDYASLIFLRDGNYYLGIINPKRKKNIKFEQGSGNGPFYRKMVYKQIPGPNKNLPAVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 95 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNKVYDYASLIFLRDGNYYLGIINPKRKKNIKFEQGSGNGPFYRKMVYKQIPGPNKNLPDVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 96 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNKVYDYASLIFLRDGNYYLGIINPKRKKNIKFEQGSGNGPFYRKMVYKQIPGPNKNLPEVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 97 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNAVYDYASLIFLRDGNYYLGIINPKRKKNIKFEQGSGNGPFYRKMVYKQIPGPNKNLPAVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 98 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNAVYDYASLIFLRDGNYYLGIINPKRKKNIKFEQGSGNGPFYRKMVYKQIPGPNKNLPDVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 99 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNAVYDYASLIFLRDGNYYLGIINPKRKKNIKFEQGSGNGPFYRKMVYKQIPGPNKNLPEVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 100 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNDVYDYASLIFLRDGNYYLGIINPKRKKNIKFEQGSGNGPFYRKMVYKQIPGPNKNLPAVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 101 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNDVYDYASLIFLRDGNYYLGIINPKRKKNIKFEQGSGNGPFYRKMVYKQIPGPNKNLPDVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 102 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNDVYDYASLIFLRDGNYYLGIINPKRKKNIKFEQGSGNGPFYRKMVYKQIPGPNKNLPEVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 103 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNEVYDYASLIFLRDGNYYLGIINPKRKKNIKFEQGSGNGPFYRKMVYKQIPGPNKNLPAVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 104 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNEVYDYASLIFLRDGNYYLGIINPKRKKNIKFEQGSGNGPFYRKMVYKQIPGPNKNLPDVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 105 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNEVYDYASLIFLRDGNYYLGIINPKRKKNIKFEQGSGNGPFYRKMVYKQIPGPNKNLPEVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 106 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNAVYDAASLIFLRDGNYYLGIINPKRKKNIKFEQGSGNGPFYRKMVYKQIPGPNKNLPAVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 107 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNAVYDDASLIFLRDGNYYLGIINPKRKKNIKFEQGSGNGPFYRKMVYKQIPGPNKNLPAVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 108 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNAVYDEASLIFLRDGNYYLGIINPKRKKNIKFEQGSGNGPFYRKMVYKQIPGPNKNLPAVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 109 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNAVYDAASLIFLRDGNYYLGIINPKRKKNIKFEQGSGNGPFYRKMVYKQIPGPNKNLPDVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 110 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNAVYDDASLIFLRDGNYYLGIINPKRKKNIKFEQGSGNGPFYRKMVYKQIPGPNKNLPDVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 111 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNAVYDEASLIFLRDGNYYLGIINPKRKKNIKFEQGSGNGPFYRKMVYKQIPGPNKNLPDVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 112 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNAVYDAASLIFLRDGNYYLGIINPKRKKNIKFEQGSGNGPFYRKMVYKQIPGPNKNLPEVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 113 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNAVYDDASLIFLRDGNYYLGIINPKRKKNIKFEQGSGNGPFYRKMVYKQIPGPNKNLPEVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 114 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNAVYDEASLIFLRDGNYYLGIINPKRKKNIKFEQGSGNGPFYRKMVYKQIPGPNKNLPEVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 115 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNDVYDAASLIFLRDGNYYLGIINPKRKKNIKFEQGSGNGPFYRKMVYKQIPGPNKNLPAVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 116 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNDVYDDASLIFLRDGNYYLGIINPKRKKNIKFEQGSGNGPFYRKMVYKQIPGPNKNLPAVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 117 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNDVYDEASLIFLRDGNYYLGIINPKRKKNIKFEQGSGNGPFYRKMVYKQIPGPNKNLPAVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 118 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNDVYDAASLIFLRDGNYYLGIINPKRKKNIKFEQGSGNGPFYRKMVYKQIPGPNKNLPDVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 119 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNDVYDDASLIFLRDGNYYLGIINPKRKKNIKFEQGSGNGPFYRKMVYKQIPGPNKNLPDVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 120 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNDVYDEASLIFLRDGNYYLGIINPKRKKNIKFEQGSGNGPFYRKMVYKQIPGPNKNLPDVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 121 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNDVYDAASLIFLRDGNYYLGIINPKRKKNIKFEQGSGNGPFYRKMVYKQIPGPNKNLPEVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 122 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNDVYDDASLIFLRDGNYYLGIINPKRKKNIKFEQGSGNGPFYRKMVYKQIPGPNKNLPEVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 123 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNDVYDEASLIFLRDGNYYLGIINPKRKKNIKFEQGSGNGPFYRKMVYKQIPGPNKNLPEVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 124 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNEVYDAASLIFLRDGNYYLGIINPKRKKNIKFEQGSGNGPFYRKMVYKQIPGPNKNLPAVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 125 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNEVYDDASLIFLRDGNYYLGIINPKRKKNIKFEQGSGNGPFYRKMVYKQIPGPNKNLPAVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 126 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNEVYDEASLIFLRDGNYYLGIINPKRKKNIKFEQGSGNGPFYRKMVYKQIPGPNKNLPAVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 127 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNEVYDAASLIFLRDGNYYLGIINPKRKKNIKFEQGSGNGPFYRKMVYKQIPGPNKNLPDVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 128 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNEVYDDASLIFLRDGNYYLGIINPKRKKNIKFEQGSGNGPFYRKMVYKQIPGPNKNLPDVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 129 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNEVYDEASLIFLRDGNYYLGIINPKRKKNIKFEQGSGNGPFYRKMVYKQIPGPNKNLPDVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 130 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNEVYDAASLIFLRDGNYYLGIINPKRKKNIKFEQGSGNGPFYRKMVYKQIPGPNKNLPEVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 131 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNEVYDDASLIFLRDGNYYLGIINPKRKKNIKFEQGSGNGPFYRKMVYKQIPGPNKNLPEVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 132 - protein, 1238 aa, unidentified
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNEVYDEASLIFLRDGNYYLGIINPKRKKNIKFEQGSGNGPFYRKMVYKQIPGPNKNLPEVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 133 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSKEFDNNAIILIRDNKYYLAIFNAKNKPDKKIIQGNSDKKNDNDYKKMVYNLLPGANKMLPAVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 134 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSKEFDNNAIILIRDNKYYLAIFNAKNKPDKKIIQGNSDKKNDNDYKKMVYNLLPGANKMLPDVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 135 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSKEFDNNAIILIRDNKYYLAIFNAKNKPDKKIIQGNSDKKNDNDYKKMVYNLLPGANKMLPEVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 136 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSAEFDNNAIILIRDNKYYLAIFNAKNKPDKKIIQGNSDKKNDNDYKKMVYNLLPGANKMLPAVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 137 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSAEFDNNAIILIRDNKYYLAIFNAKNKPDKKIIQGNSDKKNDNDYKKMVYNLLPGANKMLPDVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 138 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSAEFDNNAIILIRDNKYYLAIFNAKNKPDKKIIQGNSDKKNDNDYKKMVYNLLPGANKMLPEVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 139 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSDEFDNNAIILIRDNKYYLAIFNAKNKPDKKIIQGNSDKKNDNDYKKMVYNLLPGANKMLPAVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 140 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSDEFDNNAIILIRDNKYYLAIFNAKNKPDKKIIQGNSDKKNDNDYKKMVYNLLPGANKMLPDVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 141 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSDEFDNNAIILIRDNKYYLAIFNAKNKPDKKIIQGNSDKKNDNDYKKMVYNLLPGANKMLPEVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 142 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSEEFDNNAIILIRDNKYYLAIFNAKNKPDKKIIQGNSDKKNDNDYKKMVYNLLPGANKMLPAVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 143 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSEEFDNNAIILIRDNKYYLAIFNAKNKPDKKIIQGNSDKKNDNDYKKMVYNLLPGANKMLPDVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 144 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSEEFDNNAIILIRDNKYYLAIFNAKNKPDKKIIQGNSDKKNDNDYKKMVYNLLPGANKMLPEVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 145 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSAEFDANAIILIRDNKYYLAIFNAKNKPDKKIIQGNSDKKNDNDYKKMVYNLLPGANKMLPAVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 146 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSAEFDDNAIILIRDNKYYLAIFNAKNKPDKKIIQGNSDKKNDNDYKKMVYNLLPGANKMLPAVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 147 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSAEFDENAIILIRDNKYYLAIFNAKNKPDKKIIQGNSDKKNDNDYKKMVYNLLPGANKMLPAVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 148 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSAEFDANAIILIRDNKYYLAIFNAKNKPDKKIIQGNSDKKNDNDYKKMVYNLLPGANKMLPDVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 149 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSAEFDDNAIILIRDNKYYLAIFNAKNKPDKKIIQGNSDKKNDNDYKKMVYNLLPGANKMLPDVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 150 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSAEFDENAIILIRDNKYYLAIFNAKNKPDKKIIQGNSDKKNDNDYKKMVYNLLPGANKMLPDVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 151 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSAEFDANAIILIRDNKYYLAIFNAKNKPDKKIIQGNSDKKNDNDYKKMVYNLLPGANKMLPEVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 152 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSAEFDDNAIILIRDNKYYLAIFNAKNKPDKKIIQGNSDKKNDNDYKKMVYNLLPGANKMLPEVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 153 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSAEFDENAIILIRDNKYYLAIFNAKNKPDKKIIQGNSDKKNDNDYKKMVYNLLPGANKMLPEVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 154 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSDEFDANAIILIRDNKYYLAIFNAKNKPDKKIIQGNSDKKNDNDYKKMVYNLLPGANKMLPAVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 155 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSDEFDDNAIILIRDNKYYLAIFNAKNKPDKKIIQGNSDKKNDNDYKKMVYNLLPGANKMLPAVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 156 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSDEFDENAIILIRDNKYYLAIFNAKNKPDKKIIQGNSDKKNDNDYKKMVYNLLPGANKMLPAVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 157 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSDEFDANAIILIRDNKYYLAIFNAKNKPDKKIIQGNSDKKNDNDYKKMVYNLLPGANKMLPDVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 158 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSDEFDDNAIILIRDNKYYLAIFNAKNKPDKKIIQGNSDKKNDNDYKKMVYNLLPGANKMLPDVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 159 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSDEFDENAIILIRDNKYYLAIFNAKNKPDKKIIQGNSDKKNDNDYKKMVYNLLPGANKMLPDVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 160 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSDEFDANAIILIRDNKYYLAIFNAKNKPDKKIIQGNSDKKNDNDYKKMVYNLLPGANKMLPEVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 161 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSDEFDDNAIILIRDNKYYLAIFNAKNKPDKKIIQGNSDKKNDNDYKKMVYNLLPGANKMLPEVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 162 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSDEFDENAIILIRDNKYYLAIFNAKNKPDKKIIQGNSDKKNDNDYKKMVYNLLPGANKMLPEVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 163 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSEEFDANAIILIRDNKYYLAIFNAKNKPDKKIIQGNSDKKNDNDYKKMVYNLLPGANKMLPAVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 164 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSEEFDDNAIILIRDNKYYLAIFNAKNKPDKKIIQGNSDKKNDNDYKKMVYNLLPGANKMLPAVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 165 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSEEFDENAIILIRDNKYYLAIFNAKNKPDKKIIQGNSDKKNDNDYKKMVYNLLPGANKMLPAVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 166 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSEEFDANAIILIRDNKYYLAIFNAKNKPDKKIIQGNSDKKNDNDYKKMVYNLLPGANKMLPDVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 167 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSEEFDDNAIILIRDNKYYLAIFNAKNKPDKKIIQGNSDKKNDNDYKKMVYNLLPGANKMLPDVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 168 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSEEFDENAIILIRDNKYYLAIFNAKNKPDKKIIQGNSDKKNDNDYKKMVYNLLPGANKMLPDVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 169 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSEEFDANAIILIRDNKYYLAIFNAKNKPDKKIIQGNSDKKNDNDYKKMVYNLLPGANKMLPEVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 170 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSEEFDDNAIILIRDNKYYLAIFNAKNKPDKKIIQGNSDKKNDNDYKKMVYNLLPGANKMLPEVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 171 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSEEFDENAIILIRDNKYYLAIFNAKNKPDKKIIQGNSDKKNDNDYKKMVYNLLPGANKMLPEVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 172 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNKEKDNFGVILQKDGCYYLALLDKAHKKVFDNAPNTGKSVYQKMIYKLLPGPNKMLPAVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 173 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNKEKDNFGVILQKDGCYYLALLDKAHKKVFDNAPNTGKSVYQKMIYKLLPGPNKMLPDVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 174 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNKEKDNFGVILQKDGCYYLALLDKAHKKVFDNAPNTGKSVYQKMIYKLLPGPNKMLPEVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 175 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNAEKDNFGVILQKDGCYYLALLDKAHKKVFDNAPNTGKSVYQKMIYKLLPGPNKMLPAVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 176 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNAEKDNFGVILQKDGCYYLALLDKAHKKVFDNAPNTGKSVYQKMIYKLLPGPNKMLPDVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 177 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNAEKDNFGVILQKDGCYYLALLDKAHKKVFDNAPNTGKSVYQKMIYKLLPGPNKMLPEVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 178 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNDEKDNFGVILQKDGCYYLALLDKAHKKVFDNAPNTGKSVYQKMIYKLLPGPNKMLPAVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 179 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNDEKDNFGVILQKDGCYYLALLDKAHKKVFDNAPNTGKSVYQKMIYKLLPGPNKMLPDVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 180 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNDEKDNFGVILQKDGCYYLALLDKAHKKVFDNAPNTGKSVYQKMIYKLLPGPNKMLPEVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 181 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNEEKDNFGVILQKDGCYYLALLDKAHKKVFDNAPNTGKSVYQKMIYKLLPGPNKMLPAVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 182 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNEEKDNFGVILQKDGCYYLALLDKAHKKVFDNAPNTGKSVYQKMIYKLLPGPNKMLPDVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 183 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNEEKDNFGVILQKDGCYYLALLDKAHKKVFDNAPNTGKSVYQKMIYKLLPGPNKMLPEVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 184 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNAEKDAFGVILQKDGCYYLALLDKAHKKVFDNAPNTGKSVYQKMIYKLLPGPNKMLPAVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 185 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNAEKDDFGVILQKDGCYYLALLDKAHKKVFDNAPNTGKSVYQKMIYKLLPGPNKMLPAVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 186 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNAEKDEFGVILQKDGCYYLALLDKAHKKVFDNAPNTGKSVYQKMIYKLLPGPNKMLPAVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 187 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNAEKDAFGVILQKDGCYYLALLDKAHKKVFDNAPNTGKSVYQKMIYKLLPGPNKMLPDVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 188 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNAEKDDFGVILQKDGCYYLALLDKAHKKVFDNAPNTGKSVYQKMIYKLLPGPNKMLPDVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 189 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNAEKDEFGVILQKDGCYYLALLDKAHKKVFDNAPNTGKSVYQKMIYKLLPGPNKMLPDVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 190 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNAEKDAFGVILQKDGCYYLALLDKAHKKVFDNAPNTGKSVYQKMIYKLLPGPNKMLPEVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 191 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNAEKDDFGVILQKDGCYYLALLDKAHKKVFDNAPNTGKSVYQKMIYKLLPGPNKMLPEVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 192 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNAEKDEFGVILQKDGCYYLALLDKAHKKVFDNAPNTGKSVYQKMIYKLLPGPNKMLPEVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 193 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNDEKDAFGVILQKDGCYYLALLDKAHKKVFDNAPNTGKSVYQKMIYKLLPGPNKMLPAVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 194 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNDEKDDFGVILQKDGCYYLALLDKAHKKVFDNAPNTGKSVYQKMIYKLLPGPNKMLPAVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 195 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNDEKDEFGVILQKDGCYYLALLDKAHKKVFDNAPNTGKSVYQKMIYKLLPGPNKMLPAVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 196 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNDEKDAFGVILQKDGCYYLALLDKAHKKVFDNAPNTGKSVYQKMIYKLLPGPNKMLPDVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 197 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNDEKDDFGVILQKDGCYYLALLDKAHKKVFDNAPNTGKSVYQKMIYKLLPGPNKMLPDVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 198 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNDEKDEFGVILQKDGCYYLALLDKAHKKVFDNAPNTGKSVYQKMIYKLLPGPNKMLPDVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 199 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNDEKDAFGVILQKDGCYYLALLDKAHKKVFDNAPNTGKSVYQKMIYKLLPGPNKMLPEVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 200 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNDEKDDFGVILQKDGCYYLALLDKAHKKVFDNAPNTGKSVYQKMIYKLLPGPNKMLPEVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 201 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNDEKDEFGVILQKDGCYYLALLDKAHKKVFDNAPNTGKSVYQKMIYKLLPGPNKMLPEVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 202 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNEEKDAFGVILQKDGCYYLALLDKAHKKVFDNAPNTGKSVYQKMIYKLLPGPNKMLPAVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 203 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNEEKDDFGVILQKDGCYYLALLDKAHKKVFDNAPNTGKSVYQKMIYKLLPGPNKMLPAVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 204 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNEEKDEFGVILQKDGCYYLALLDKAHKKVFDNAPNTGKSVYQKMIYKLLPGPNKMLPAVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 205 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNEEKDAFGVILQKDGCYYLALLDKAHKKVFDNAPNTGKSVYQKMIYKLLPGPNKMLPDVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 206 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNEEKDDFGVILQKDGCYYLALLDKAHKKVFDNAPNTGKSVYQKMIYKLLPGPNKMLPDVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 207 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNEEKDEFGVILQKDGCYYLALLDKAHKKVFDNAPNTGKSVYQKMIYKLLPGPNKMLPDVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 208 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNEEKDAFGVILQKDGCYYLALLDKAHKKVFDNAPNTGKSVYQKMIYKLLPGPNKMLPEVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 209 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNEEKDDFGVILQKDGCYYLALLDKAHKKVFDNAPNTGKSVYQKMIYKLLPGPNKMLPEVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 210 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNEEKDEFGVILQKDGCYYLALLDKAHKKVFDNAPNTGKSVYQKMIYKLLPGPNKMLPEVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 211 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPAVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 212 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPDVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 213 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPEVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 214 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNAEPDNTAILFIKDDKYYLGVMNKKNNKIFDDKAIKENKGEGYKKIVYKLLPGANKMLPAVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 215 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNAEPDNTAILFIKDDKYYLGVMNKKNNKIFDDKAIKENKGEGYKKIVYKLLPGANKMLPDVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 216 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNAEPDNTAILFIKDDKYYLGVMNKKNNKIFDDKAIKENKGEGYKKIVYKLLPGANKMLPEVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 217 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNDEPDNTAILFIKDDKYYLGVMNKKNNKIFDDKAIKENKGEGYKKIVYKLLPGANKMLPAVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 218 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNDEPDNTAILFIKDDKYYLGVMNKKNNKIFDDKAIKENKGEGYKKIVYKLLPGANKMLPDVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 219 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNDEPDNTAILFIKDDKYYLGVMNKKNNKIFDDKAIKENKGEGYKKIVYKLLPGANKMLPEVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 220 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNEEPDNTAILFIKDDKYYLGVMNKKNNKIFDDKAIKENKGEGYKKIVYKLLPGANKMLPAVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 221 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNEEPDNTAILFIKDDKYYLGVMNKKNNKIFDDKAIKENKGEGYKKIVYKLLPGANKMLPDVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 222 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNEEPDNTAILFIKDDKYYLGVMNKKNNKIFDDKAIKENKGEGYKKIVYKLLPGANKMLPEVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 223 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNAEPDATAILFIKDDKYYLGVMNKKNNKIFDDKAIKENKGEGYKKIVYKLLPGANKMLPAVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 224 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNAEPDDTAILFIKDDKYYLGVMNKKNNKIFDDKAIKENKGEGYKKIVYKLLPGANKMLPAVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 225 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNAEPDETAILFIKDDKYYLGVMNKKNNKIFDDKAIKENKGEGYKKIVYKLLPGANKMLPAVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 226 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNAEPDATAILFIKDDKYYLGVMNKKNNKIFDDKAIKENKGEGYKKIVYKLLPGANKMLPDVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 227 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNAEPDDTAILFIKDDKYYLGVMNKKNNKIFDDKAIKENKGEGYKKIVYKLLPGANKMLPDVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 228 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNAEPDETAILFIKDDKYYLGVMNKKNNKIFDDKAIKENKGEGYKKIVYKLLPGANKMLPDVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 229 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNAEPDATAILFIKDDKYYLGVMNKKNNKIFDDKAIKENKGEGYKKIVYKLLPGANKMLPEVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 230 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNAEPDDTAILFIKDDKYYLGVMNKKNNKIFDDKAIKENKGEGYKKIVYKLLPGANKMLPEVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 231 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNAEPDETAILFIKDDKYYLGVMNKKNNKIFDDKAIKENKGEGYKKIVYKLLPGANKMLPEVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 232 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNDEPDATAILFIKDDKYYLGVMNKKNNKIFDDKAIKENKGEGYKKIVYKLLPGANKMLPAVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 233 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNDEPDDTAILFIKDDKYYLGVMNKKNNKIFDDKAIKENKGEGYKKIVYKLLPGANKMLPAVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 234 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNDEPDETAILFIKDDKYYLGVMNKKNNKIFDDKAIKENKGEGYKKIVYKLLPGANKMLPAVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 235 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNDEPDATAILFIKDDKYYLGVMNKKNNKIFDDKAIKENKGEGYKKIVYKLLPGANKMLPDVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 236 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNDEPDDTAILFIKDDKYYLGVMNKKNNKIFDDKAIKENKGEGYKKIVYKLLPGANKMLPDVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 237 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNDEPDETAILFIKDDKYYLGVMNKKNNKIFDDKAIKENKGEGYKKIVYKLLPGANKMLPDVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 238 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNDEPDATAILFIKDDKYYLGVMNKKNNKIFDDKAIKENKGEGYKKIVYKLLPGANKMLPEVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 239 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNDEPDDTAILFIKDDKYYLGVMNKKNNKIFDDKAIKENKGEGYKKIVYKLLPGANKMLPEVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 240 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNDEPDETAILFIKDDKYYLGVMNKKNNKIFDDKAIKENKGEGYKKIVYKLLPGANKMLPEVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 241 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNEEPDATAILFIKDDKYYLGVMNKKNNKIFDDKAIKENKGEGYKKIVYKLLPGANKMLPAVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 242 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNEEPDDTAILFIKDDKYYLGVMNKKNNKIFDDKAIKENKGEGYKKIVYKLLPGANKMLPAVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 243 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNEEPDETAILFIKDDKYYLGVMNKKNNKIFDDKAIKENKGEGYKKIVYKLLPGANKMLPAVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 244 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNEEPDATAILFIKDDKYYLGVMNKKNNKIFDDKAIKENKGEGYKKIVYKLLPGANKMLPDVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 245 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNEEPDDTAILFIKDDKYYLGVMNKKNNKIFDDKAIKENKGEGYKKIVYKLLPGANKMLPDVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 246 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNEEPDETAILFIKDDKYYLGVMNKKNNKIFDDKAIKENKGEGYKKIVYKLLPGANKMLPDVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 247 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNEEPDATAILFIKDDKYYLGVMNKKNNKIFDDKAIKENKGEGYKKIVYKLLPGANKMLPEVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 248 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNEEPDDTAILFIKDDKYYLGVMNKKNNKIFDDKAIKENKGEGYKKIVYKLLPGANKMLPEVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 249 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNEEPDETAILFIKDDKYYLGVMNKKNNKIFDDKAIKENKGEGYKKIVYKLLPGANKMLPEVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 250 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNKESANTAILFIKDDKYYLGIMDKKHNKIFSDKAIEENKGEGYKKIVYKQIADASKDIQALMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 251 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNKESANTAILFIKDDKYYLGIMDKKHNKIFSDKAIEENKGEGYKKIVYKQIADASKDIQDLMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 252 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNKESANTAILFIKDDKYYLGIMDKKHNKIFSDKAIEENKGEGYKKIVYKQIADASKDIQELMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 253 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNAESANTAILFIKDDKYYLGIMDKKHNKIFSDKAIEENKGEGYKKIVYKQIADASKDIQALMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 254 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNAESANTAILFIKDDKYYLGIMDKKHNKIFSDKAIEENKGEGYKKIVYKQIADASKDIQDLMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 255 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNAESANTAILFIKDDKYYLGIMDKKHNKIFSDKAIEENKGEGYKKIVYKQIADASKDIQELMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 256 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNDESANTAILFIKDDKYYLGIMDKKHNKIFSDKAIEENKGEGYKKIVYKQIADASKDIQALMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 257 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNDESANTAILFIKDDKYYLGIMDKKHNKIFSDKAIEENKGEGYKKIVYKQIADASKDIQDLMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 258 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNDESANTAILFIKDDKYYLGIMDKKHNKIFSDKAIEENKGEGYKKIVYKQIADASKDIQELMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 259 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNEESANTAILFIKDDKYYLGIMDKKHNKIFSDKAIEENKGEGYKKIVYKQIADASKDIQALMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 260 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNEESANTAILFIKDDKYYLGIMDKKHNKIFSDKAIEENKGEGYKKIVYKQIADASKDIQDLMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 261 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNEESANTAILFIKDDKYYLGIMDKKHNKIFSDKAIEENKGEGYKKIVYKQIADASKDIQELMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 262 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNAESAATAILFIKDDKYYLGIMDKKHNKIFSDKAIEENKGEGYKKIVYKQIADASKDIQALMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 263 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNAESADTAILFIKDDKYYLGIMDKKHNKIFSDKAIEENKGEGYKKIVYKQIADASKDIQALMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 264 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNAESAETAILFIKDDKYYLGIMDKKHNKIFSDKAIEENKGEGYKKIVYKQIADASKDIQALMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 265 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNAESAATAILFIKDDKYYLGIMDKKHNKIFSDKAIEENKGEGYKKIVYKQIADASKDIQDLMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 266 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNAESADTAILFIKDDKYYLGIMDKKHNKIFSDKAIEENKGEGYKKIVYKQIADASKDIQDLMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 267 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNAESAETAILFIKDDKYYLGIMDKKHNKIFSDKAIEENKGEGYKKIVYKQIADASKDIQDLMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 268 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNAESAATAILFIKDDKYYLGIMDKKHNKIFSDKAIEENKGEGYKKIVYKQIADASKDIQELMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 269 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNAESADTAILFIKDDKYYLGIMDKKHNKIFSDKAIEENKGEGYKKIVYKQIADASKDIQELMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 270 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNAESAETAILFIKDDKYYLGIMDKKHNKIFSDKAIEENKGEGYKKIVYKQIADASKDIQELMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 271 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNDESAATAILFIKDDKYYLGIMDKKHNKIFSDKAIEENKGEGYKKIVYKQIADASKDIQALMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 272 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNDESADTAILFIKDDKYYLGIMDKKHNKIFSDKAIEENKGEGYKKIVYKQIADASKDIQALMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 273 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNDESAETAILFIKDDKYYLGIMDKKHNKIFSDKAIEENKGEGYKKIVYKQIADASKDIQALMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 274 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNDESAATAILFIKDDKYYLGIMDKKHNKIFSDKAIEENKGEGYKKIVYKQIADASKDIQDLMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 275 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNDESADTAILFIKDDKYYLGIMDKKHNKIFSDKAIEENKGEGYKKIVYKQIADASKDIQDLMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 276 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNDESAETAILFIKDDKYYLGIMDKKHNKIFSDKAIEENKGEGYKKIVYKQIADASKDIQDLMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 277 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNDESAATAILFIKDDKYYLGIMDKKHNKIFSDKAIEENKGEGYKKIVYKQIADASKDIQELMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 278 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNDESADTAILFIKDDKYYLGIMDKKHNKIFSDKAIEENKGEGYKKIVYKQIADASKDIQELMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 279 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNDESAETAILFIKDDKYYLGIMDKKHNKIFSDKAIEENKGEGYKKIVYKQIADASKDIQELMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 280 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNEESAATAILFIKDDKYYLGIMDKKHNKIFSDKAIEENKGEGYKKIVYKQIADASKDIQALMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 281 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNEESADTAILFIKDDKYYLGIMDKKHNKIFSDKAIEENKGEGYKKIVYKQIADASKDIQALMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 282 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNEESAETAILFIKDDKYYLGIMDKKHNKIFSDKAIEENKGEGYKKIVYKQIADASKDIQALMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 283 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNEESAATAILFIKDDKYYLGIMDKKHNKIFSDKAIEENKGEGYKKIVYKQIADASKDIQDLMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 284 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNEESADTAILFIKDDKYYLGIMDKKHNKIFSDKAIEENKGEGYKKIVYKQIADASKDIQDLMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 285 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNEESAETAILFIKDDKYYLGIMDKKHNKIFSDKAIEENKGEGYKKIVYKQIADASKDIQDLMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 286 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNEESAATAILFIKDDKYYLGIMDKKHNKIFSDKAIEENKGEGYKKIVYKQIADASKDIQELMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 287 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNEESADTAILFIKDDKYYLGIMDKKHNKIFSDKAIEENKGEGYKKIVYKQIADASKDIQELMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 288 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNEESAETAILFIKDDKYYLGIMDKKHNKIFSDKAIEENKGEGYKKIVYKQIADASKDIQELMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 289 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNKETDNTSVILRKDGLYYLAIMPQDNKNVFKDSPDLKANENCFEKMDYKQMALPMGFGAFVRACFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 290 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNKETDNTSVILRKDGLYYLAIMPQDNKNVFKDSPDLKANENCFEKMDYKQMALPMGFGAFVRDCFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 291 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNKETDNTSVILRKDGLYYLAIMPQDNKNVFKDSPDLKANENCFEKMDYKQMALPMGFGAFVRECFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 292 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNAETDNTSVILRKDGLYYLAIMPQDNKNVFKDSPDLKANENCFEKMDYKQMALPMGFGAFVRACFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 293 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNAETDNTSVILRKDGLYYLAIMPQDNKNVFKDSPDLKANENCFEKMDYKQMALPMGFGAFVRDCFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 294 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNAETDNTSVILRKDGLYYLAIMPQDNKNVFKDSPDLKANENCFEKMDYKQMALPMGFGAFVRECFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 295 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNDETDNTSVILRKDGLYYLAIMPQDNKNVFKDSPDLKANENCFEKMDYKQMALPMGFGAFVRACFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 296 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNDETDNTSVILRKDGLYYLAIMPQDNKNVFKDSPDLKANENCFEKMDYKQMALPMGFGAFVRDCFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 297 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNDETDNTSVILRKDGLYYLAIMPQDNKNVFKDSPDLKANENCFEKMDYKQMALPMGFGAFVRECFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 298 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNEETDNTSVILRKDGLYYLAIMPQDNKNVFKDSPDLKANENCFEKMDYKQMALPMGFGAFVRACFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 299 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNEETDNTSVILRKDGLYYLAIMPQDNKNVFKDSPDLKANENCFEKMDYKQMALPMGFGAFVRDCFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 300 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNEETDNTSVILRKDGLYYLAIMPQDNKNVFKDSPDLKANENCFEKMDYKQMALPMGFGAFVRECFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 301 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNAETDATSVILRKDGLYYLAIMPQDNKNVFKDSPDLKANENCFEKMDYKQMALPMGFGAFVRACFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 302 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNAETDDTSVILRKDGLYYLAIMPQDNKNVFKDSPDLKANENCFEKMDYKQMALPMGFGAFVRACFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 303 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNAETDETSVILRKDGLYYLAIMPQDNKNVFKDSPDLKANENCFEKMDYKQMALPMGFGAFVRACFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 304 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNAETDATSVILRKDGLYYLAIMPQDNKNVFKDSPDLKANENCFEKMDYKQMALPMGFGAFVRDCFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 305 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNAETDDTSVILRKDGLYYLAIMPQDNKNVFKDSPDLKANENCFEKMDYKQMALPMGFGAFVRDCFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 306 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNAETDETSVILRKDGLYYLAIMPQDNKNVFKDSPDLKANENCFEKMDYKQMALPMGFGAFVRDCFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 307 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNAETDATSVILRKDGLYYLAIMPQDNKNVFKDSPDLKANENCFEKMDYKQMALPMGFGAFVRECFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 308 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNAETDDTSVILRKDGLYYLAIMPQDNKNVFKDSPDLKANENCFEKMDYKQMALPMGFGAFVRECFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 309 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNAETDETSVILRKDGLYYLAIMPQDNKNVFKDSPDLKANENCFEKMDYKQMALPMGFGAFVRECFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 310 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNDETDATSVILRKDGLYYLAIMPQDNKNVFKDSPDLKANENCFEKMDYKQMALPMGFGAFVRACFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 311 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNDETDDTSVILRKDGLYYLAIMPQDNKNVFKDSPDLKANENCFEKMDYKQMALPMGFGAFVRACFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 312 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNDETDETSVILRKDGLYYLAIMPQDNKNVFKDSPDLKANENCFEKMDYKQMALPMGFGAFVRACFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 313 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNDETDATSVILRKDGLYYLAIMPQDNKNVFKDSPDLKANENCFEKMDYKQMALPMGFGAFVRDCFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 314 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNDETDDTSVILRKDGLYYLAIMPQDNKNVFKDSPDLKANENCFEKMDYKQMALPMGFGAFVRDCFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 315 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNDETDETSVILRKDGLYYLAIMPQDNKNVFKDSPDLKANENCFEKMDYKQMALPMGFGAFVRDCFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 316 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNDETDATSVILRKDGLYYLAIMPQDNKNVFKDSPDLKANENCFEKMDYKQMALPMGFGAFVRECFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 317 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNDETDDTSVILRKDGLYYLAIMPQDNKNVFKDSPDLKANENCFEKMDYKQMALPMGFGAFVRECFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 318 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNDETDETSVILRKDGLYYLAIMPQDNKNVFKDSPDLKANENCFEKMDYKQMALPMGFGAFVRECFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 319 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNEETDATSVILRKDGLYYLAIMPQDNKNVFKDSPDLKANENCFEKMDYKQMALPMGFGAFVRACFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 320 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNEETDDTSVILRKDGLYYLAIMPQDNKNVFKDSPDLKANENCFEKMDYKQMALPMGFGAFVRACFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 321 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNEETDETSVILRKDGLYYLAIMPQDNKNVFKDSPDLKANENCFEKMDYKQMALPMGFGAFVRACFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 322 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNEETDATSVILRKDGLYYLAIMPQDNKNVFKDSPDLKANENCFEKMDYKQMALPMGFGAFVRDCFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 323 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNEETDDTSVILRKDGLYYLAIMPQDNKNVFKDSPDLKANENCFEKMDYKQMALPMGFGAFVRDCFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 324 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNEETDETSVILRKDGLYYLAIMPQDNKNVFKDSPDLKANENCFEKMDYKQMALPMGFGAFVRDCFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 325 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNEETDATSVILRKDGLYYLAIMPQDNKNVFKDSPDLKANENCFEKMDYKQMALPMGFGAFVRECFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 326 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNEETDDTSVILRKDGLYYLAIMPQDNKNVFKDSPDLKANENCFEKMDYKQMALPMGFGAFVRECFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 327 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNEETDETSVILRKDGLYYLAIMPQDNKNVFKDSPDLKANENCFEKMDYKQMALPMGFGAFVRECFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 328 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSKEFDNNAIILIRDNKYYLAIFNAKNKPDKKIIQGNSDKKNDNDYKKMVYNLLPGANKMLPAVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 329 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSKEFDNNAIILIRDNKYYLAIFNAKNKPDKKIIQGNSDKKNDNDYKKMVYNLLPGANKMLPDVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 330 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSKEFDNNAIILIRDNKYYLAIFNAKNKPDKKIIQGNSDKKNDNDYKKMVYNLLPGANKMLPEVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 331 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSAEFDNNAIILIRDNKYYLAIFNAKNKPDKKIIQGNSDKKNDNDYKKMVYNLLPGANKMLPAVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 332 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSAEFDNNAIILIRDNKYYLAIFNAKNKPDKKIIQGNSDKKNDNDYKKMVYNLLPGANKMLPDVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 333 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSAEFDNNAIILIRDNKYYLAIFNAKNKPDKKIIQGNSDKKNDNDYKKMVYNLLPGANKMLPEVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 334 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSDEFDNNAIILIRDNKYYLAIFNAKNKPDKKIIQGNSDKKNDNDYKKMVYNLLPGANKMLPAVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 335 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSDEFDNNAIILIRDNKYYLAIFNAKNKPDKKIIQGNSDKKNDNDYKKMVYNLLPGANKMLPDVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 336 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSDEFDNNAIILIRDNKYYLAIFNAKNKPDKKIIQGNSDKKNDNDYKKMVYNLLPGANKMLPEVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 337 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSEEFDNNAIILIRDNKYYLAIFNAKNKPDKKIIQGNSDKKNDNDYKKMVYNLLPGANKMLPAVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 338 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSEEFDNNAIILIRDNKYYLAIFNAKNKPDKKIIQGNSDKKNDNDYKKMVYNLLPGANKMLPDVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 339 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSEEFDNNAIILIRDNKYYLAIFNAKNKPDKKIIQGNSDKKNDNDYKKMVYNLLPGANKMLPEVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 340 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSAEFDANAIILIRDNKYYLAIFNAKNKPDKKIIQGNSDKKNDNDYKKMVYNLLPGANKMLPAVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 341 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSAEFDDNAIILIRDNKYYLAIFNAKNKPDKKIIQGNSDKKNDNDYKKMVYNLLPGANKMLPAVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 342 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSAEFDENAIILIRDNKYYLAIFNAKNKPDKKIIQGNSDKKNDNDYKKMVYNLLPGANKMLPAVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 343 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSAEFDANAIILIRDNKYYLAIFNAKNKPDKKIIQGNSDKKNDNDYKKMVYNLLPGANKMLPDVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 344 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSAEFDDNAIILIRDNKYYLAIFNAKNKPDKKIIQGNSDKKNDNDYKKMVYNLLPGANKMLPDVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 345 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSAEFDENAIILIRDNKYYLAIFNAKNKPDKKIIQGNSDKKNDNDYKKMVYNLLPGANKMLPDVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 346 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSAEFDANAIILIRDNKYYLAIFNAKNKPDKKIIQGNSDKKNDNDYKKMVYNLLPGANKMLPEVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 347 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSAEFDDNAIILIRDNKYYLAIFNAKNKPDKKIIQGNSDKKNDNDYKKMVYNLLPGANKMLPEVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 348 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSAEFDENAIILIRDNKYYLAIFNAKNKPDKKIIQGNSDKKNDNDYKKMVYNLLPGANKMLPEVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 349 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSDEFDANAIILIRDNKYYLAIFNAKNKPDKKIIQGNSDKKNDNDYKKMVYNLLPGANKMLPAVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 350 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSDEFDDNAIILIRDNKYYLAIFNAKNKPDKKIIQGNSDKKNDNDYKKMVYNLLPGANKMLPAVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 351 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSDEFDENAIILIRDNKYYLAIFNAKNKPDKKIIQGNSDKKNDNDYKKMVYNLLPGANKMLPAVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 352 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSDEFDANAIILIRDNKYYLAIFNAKNKPDKKIIQGNSDKKNDNDYKKMVYNLLPGANKMLPDVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 353 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSDEFDDNAIILIRDNKYYLAIFNAKNKPDKKIIQGNSDKKNDNDYKKMVYNLLPGANKMLPDVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 354 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSDEFDENAIILIRDNKYYLAIFNAKNKPDKKIIQGNSDKKNDNDYKKMVYNLLPGANKMLPDVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 355 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSDEFDANAIILIRDNKYYLAIFNAKNKPDKKIIQGNSDKKNDNDYKKMVYNLLPGANKMLPEVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 356 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSDEFDDNAIILIRDNKYYLAIFNAKNKPDKKIIQGNSDKKNDNDYKKMVYNLLPGANKMLPEVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 357 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSDEFDENAIILIRDNKYYLAIFNAKNKPDKKIIQGNSDKKNDNDYKKMVYNLLPGANKMLPEVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 358 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSEEFDANAIILIRDNKYYLAIFNAKNKPDKKIIQGNSDKKNDNDYKKMVYNLLPGANKMLPAVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 359 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSEEFDDNAIILIRDNKYYLAIFNAKNKPDKKIIQGNSDKKNDNDYKKMVYNLLPGANKMLPAVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 360 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSEEFDENAIILIRDNKYYLAIFNAKNKPDKKIIQGNSDKKNDNDYKKMVYNLLPGANKMLPAVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 361 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSEEFDANAIILIRDNKYYLAIFNAKNKPDKKIIQGNSDKKNDNDYKKMVYNLLPGANKMLPDVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 362 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSEEFDDNAIILIRDNKYYLAIFNAKNKPDKKIIQGNSDKKNDNDYKKMVYNLLPGANKMLPDVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 363 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSEEFDENAIILIRDNKYYLAIFNAKNKPDKKIIQGNSDKKNDNDYKKMVYNLLPGANKMLPDVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 364 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSEEFDANAIILIRDNKYYLAIFNAKNKPDKKIIQGNSDKKNDNDYKKMVYNLLPGANKMLPEVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 365 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSEEFDDNAIILIRDNKYYLAIFNAKNKPDKKIIQGNSDKKNDNDYKKMVYNLLPGANKMLPEVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 366 - protein, 1282 aa, Lachnospira sp.
MNGNRSIVYREFVGVTPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLFKEILPDFIKNYNQYDVKDKAGKLETVALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTRNNYNLFKMRKLHKQILAYTSTSFEVPKMFEDDMSVYNAVNAFIDETEKGNIIVKLKDIVNKYDELDEKRIYISKDFYETLSCFISGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSEEFDENAIILIRDNKYYLAIFNAKNKPDKKIIQGNSDKKNDNDYKKMVYNLLPGANKMLPEVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKYFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLRGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLKDNKINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 367 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKNVYQKMVYKLLPGPNKMLPAVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 368 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKNVYQKMVYKLLPGPNKMLPDVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 369 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKNVYQKMVYKLLPGPNKMLPEVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 370 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNAEKDNFGVILQKDGCYYLALLDKAHKKVFDNAPNTGKNVYQKMVYKLLPGPNKMLPAVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 371 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNAEKDNFGVILQKDGCYYLALLDKAHKKVFDNAPNTGKNVYQKMVYKLLPGPNKMLPDVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 372 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNAEKDNFGVILQKDGCYYLALLDKAHKKVFDNAPNTGKNVYQKMVYKLLPGPNKMLPEVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 373 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNDEKDNFGVILQKDGCYYLALLDKAHKKVFDNAPNTGKNVYQKMVYKLLPGPNKMLPAVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 374 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNDEKDNFGVILQKDGCYYLALLDKAHKKVFDNAPNTGKNVYQKMVYKLLPGPNKMLPDVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 375 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNDEKDNFGVILQKDGCYYLALLDKAHKKVFDNAPNTGKNVYQKMVYKLLPGPNKMLPEVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 376 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNEEKDNFGVILQKDGCYYLALLDKAHKKVFDNAPNTGKNVYQKMVYKLLPGPNKMLPAVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 377 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNEEKDNFGVILQKDGCYYLALLDKAHKKVFDNAPNTGKNVYQKMVYKLLPGPNKMLPDVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 378 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNEEKDNFGVILQKDGCYYLALLDKAHKKVFDNAPNTGKNVYQKMVYKLLPGPNKMLPEVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 379 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNAEKDAFGVILQKDGCYYLALLDKAHKKVFDNAPNTGKNVYQKMVYKLLPGPNKMLPAVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 380 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNAEKDDFGVILQKDGCYYLALLDKAHKKVFDNAPNTGKNVYQKMVYKLLPGPNKMLPAVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 381 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNAEKDEFGVILQKDGCYYLALLDKAHKKVFDNAPNTGKNVYQKMVYKLLPGPNKMLPAVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 382 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNAEKDAFGVILQKDGCYYLALLDKAHKKVFDNAPNTGKNVYQKMVYKLLPGPNKMLPDVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 383 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNAEKDDFGVILQKDGCYYLALLDKAHKKVFDNAPNTGKNVYQKMVYKLLPGPNKMLPDVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 384 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNAEKDEFGVILQKDGCYYLALLDKAHKKVFDNAPNTGKNVYQKMVYKLLPGPNKMLPDVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 385 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNAEKDAFGVILQKDGCYYLALLDKAHKKVFDNAPNTGKNVYQKMVYKLLPGPNKMLPEVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 386 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNAEKDDFGVILQKDGCYYLALLDKAHKKVFDNAPNTGKNVYQKMVYKLLPGPNKMLPEVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 387 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNAEKDEFGVILQKDGCYYLALLDKAHKKVFDNAPNTGKNVYQKMVYKLLPGPNKMLPEVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 388 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNDEKDAFGVILQKDGCYYLALLDKAHKKVFDNAPNTGKNVYQKMVYKLLPGPNKMLPAVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 389 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNDEKDDFGVILQKDGCYYLALLDKAHKKVFDNAPNTGKNVYQKMVYKLLPGPNKMLPAVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 390 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNDEKDEFGVILQKDGCYYLALLDKAHKKVFDNAPNTGKNVYQKMVYKLLPGPNKMLPAVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 391 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNDEKDAFGVILQKDGCYYLALLDKAHKKVFDNAPNTGKNVYQKMVYKLLPGPNKMLPDVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 392 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNDEKDDFGVILQKDGCYYLALLDKAHKKVFDNAPNTGKNVYQKMVYKLLPGPNKMLPDVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 393 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNDEKDEFGVILQKDGCYYLALLDKAHKKVFDNAPNTGKNVYQKMVYKLLPGPNKMLPDVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 394 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNDEKDAFGVILQKDGCYYLALLDKAHKKVFDNAPNTGKNVYQKMVYKLLPGPNKMLPEVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 395 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNDEKDDFGVILQKDGCYYLALLDKAHKKVFDNAPNTGKNVYQKMVYKLLPGPNKMLPEVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 396 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNDEKDEFGVILQKDGCYYLALLDKAHKKVFDNAPNTGKNVYQKMVYKLLPGPNKMLPEVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 397 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNEEKDAFGVILQKDGCYYLALLDKAHKKVFDNAPNTGKNVYQKMVYKLLPGPNKMLPAVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 398 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNEEKDDFGVILQKDGCYYLALLDKAHKKVFDNAPNTGKNVYQKMVYKLLPGPNKMLPAVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 399 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNEEKDEFGVILQKDGCYYLALLDKAHKKVFDNAPNTGKNVYQKMVYKLLPGPNKMLPAVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 400 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNEEKDAFGVILQKDGCYYLALLDKAHKKVFDNAPNTGKNVYQKMVYKLLPGPNKMLPDVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 401 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNEEKDDFGVILQKDGCYYLALLDKAHKKVFDNAPNTGKNVYQKMVYKLLPGPNKMLPDVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 402 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNEEKDEFGVILQKDGCYYLALLDKAHKKVFDNAPNTGKNVYQKMVYKLLPGPNKMLPDVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 403 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNEEKDAFGVILQKDGCYYLALLDKAHKKVFDNAPNTGKNVYQKMVYKLLPGPNKMLPEVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 404 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNEEKDDFGVILQKDGCYYLALLDKAHKKVFDNAPNTGKNVYQKMVYKLLPGPNKMLPEVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 405 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNEEKDEFGVILQKDGCYYLALLDKAHKKVFDNAPNTGKNVYQKMVYKLLPGPNKMLPEVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 406 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNKEHDNTAIILRKNGLYYLAIMKKSANKIFDKDKLDNSGDCYEKMVYKLLPGANKMLPAVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 407 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNKEHDNTAIILRKNGLYYLAIMKKSANKIFDKDKLDNSGDCYEKMVYKLLPGANKMLPDVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 408 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNKEHDNTAIILRKNGLYYLAIMKKSANKIFDKDKLDNSGDCYEKMVYKLLPGANKMLPEVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 409 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNAEHDNTAIILRKNGLYYLAIMKKSANKIFDKDKLDNSGDCYEKMVYKLLPGANKMLPAVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 410 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNAEHDNTAIILRKNGLYYLAIMKKSANKIFDKDKLDNSGDCYEKMVYKLLPGANKMLPDVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 411 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNAEHDNTAIILRKNGLYYLAIMKKSANKIFDKDKLDNSGDCYEKMVYKLLPGANKMLPEVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 412 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNDEHDNTAIILRKNGLYYLAIMKKSANKIFDKDKLDNSGDCYEKMVYKLLPGANKMLPAVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 413 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNDEHDNTAIILRKNGLYYLAIMKKSANKIFDKDKLDNSGDCYEKMVYKLLPGANKMLPDVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 414 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNDEHDNTAIILRKNGLYYLAIMKKSANKIFDKDKLDNSGDCYEKMVYKLLPGANKMLPEVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 415 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNEEHDNTAIILRKNGLYYLAIMKKSANKIFDKDKLDNSGDCYEKMVYKLLPGANKMLPAVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 416 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNEEHDNTAIILRKNGLYYLAIMKKSANKIFDKDKLDNSGDCYEKMVYKLLPGANKMLPDVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 417 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNEEHDNTAIILRKNGLYYLAIMKKSANKIFDKDKLDNSGDCYEKMVYKLLPGANKMLPEVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 418 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNAEHDATAIILRKNGLYYLAIMKKSANKIFDKDKLDNSGDCYEKMVYKLLPGANKMLPAVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 419 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNAEHDDTAIILRKNGLYYLAIMKKSANKIFDKDKLDNSGDCYEKMVYKLLPGANKMLPAVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 420 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNAEHDETAIILRKNGLYYLAIMKKSANKIFDKDKLDNSGDCYEKMVYKLLPGANKMLPAVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 421 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNAEHDATAIILRKNGLYYLAIMKKSANKIFDKDKLDNSGDCYEKMVYKLLPGANKMLPDVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 422 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNAEHDDTAIILRKNGLYYLAIMKKSANKIFDKDKLDNSGDCYEKMVYKLLPGANKMLPDVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 423 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNAEHDETAIILRKNGLYYLAIMKKSANKIFDKDKLDNSGDCYEKMVYKLLPGANKMLPDVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 424 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNAEHDATAIILRKNGLYYLAIMKKSANKIFDKDKLDNSGDCYEKMVYKLLPGANKMLPEVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 425 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNAEHDDTAIILRKNGLYYLAIMKKSANKIFDKDKLDNSGDCYEKMVYKLLPGANKMLPEVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 426 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNAEHDETAIILRKNGLYYLAIMKKSANKIFDKDKLDNSGDCYEKMVYKLLPGANKMLPEVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 427 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNDEHDATAIILRKNGLYYLAIMKKSANKIFDKDKLDNSGDCYEKMVYKLLPGANKMLPAVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 428 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNDEHDDTAIILRKNGLYYLAIMKKSANKIFDKDKLDNSGDCYEKMVYKLLPGANKMLPAVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 429 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNDEHDETAIILRKNGLYYLAIMKKSANKIFDKDKLDNSGDCYEKMVYKLLPGANKMLPAVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 430 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNDEHDATAIILRKNGLYYLAIMKKSANKIFDKDKLDNSGDCYEKMVYKLLPGANKMLPDVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 431 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNDEHDDTAIILRKNGLYYLAIMKKSANKIFDKDKLDNSGDCYEKMVYKLLPGANKMLPDVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 432 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNDEHDETAIILRKNGLYYLAIMKKSANKIFDKDKLDNSGDCYEKMVYKLLPGANKMLPDVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 433 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNDEHDATAIILRKNGLYYLAIMKKSANKIFDKDKLDNSGDCYEKMVYKLLPGANKMLPEVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 434 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNDEHDDTAIILRKNGLYYLAIMKKSANKIFDKDKLDNSGDCYEKMVYKLLPGANKMLPEVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 435 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNDEHDETAIILRKNGLYYLAIMKKSANKIFDKDKLDNSGDCYEKMVYKLLPGANKMLPEVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 436 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNEEHDATAIILRKNGLYYLAIMKKSANKIFDKDKLDNSGDCYEKMVYKLLPGANKMLPAVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 437 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNEEHDDTAIILRKNGLYYLAIMKKSANKIFDKDKLDNSGDCYEKMVYKLLPGANKMLPAVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 438 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNEEHDETAIILRKNGLYYLAIMKKSANKIFDKDKLDNSGDCYEKMVYKLLPGANKMLPAVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 439 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNEEHDATAIILRKNGLYYLAIMKKSANKIFDKDKLDNSGDCYEKMVYKLLPGANKMLPDVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 440 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNEEHDDTAIILRKNGLYYLAIMKKSANKIFDKDKLDNSGDCYEKMVYKLLPGANKMLPDVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 441 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNEEHDETAIILRKNGLYYLAIMKKSANKIFDKDKLDNSGDCYEKMVYKLLPGANKMLPDVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 442 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNEEHDATAIILRKNGLYYLAIMKKSANKIFDKDKLDNSGDCYEKMVYKLLPGANKMLPEVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 443 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNEEHDDTAIILRKNGLYYLAIMKKSANKIFDKDKLDNSGDCYEKMVYKLLPGANKMLPEVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 444 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNEEHDETAIILRKNGLYYLAIMKKSANKIFDKDKLDNSGDCYEKMVYKLLPGANKMLPEVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 445 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSKEKDNLGLIFIKNNKYYLGVLRKENSKLFDYQITEKDNQKEKERKNNLKNEILANDNEDFYLKMNYWQIADPAKDIFNLVLMPDNTVARFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 446 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSKEKDNLGLIFIKNNKYYLGVLRKENSKLFDYQITEKDNQKEKERKNNLKNEILANDNEDFYLKMNYWQIADPAKDIFNLVLMPDNTVDRFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 447 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSKEKDNLGLIFIKNNKYYLGVLRKENSKLFDYQITEKDNQKEKERKNNLKNEILANDNEDFYLKMNYWQIADPAKDIFNLVLMPDNTVERFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 448 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSAEKDNLGLIFIKNNKYYLGVLRKENSKLFDYQITEKDNQKEKERKNNLKNEILANDNEDFYLKMNYWQIADPAKDIFNLVLMPDNTVARFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 449 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSAEKDNLGLIFIKNNKYYLGVLRKENSKLFDYQITEKDNQKEKERKNNLKNEILANDNEDFYLKMNYWQIADPAKDIFNLVLMPDNTVDRFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 450 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSAEKDNLGLIFIKNNKYYLGVLRKENSKLFDYQITEKDNQKEKERKNNLKNEILANDNEDFYLKMNYWQIADPAKDIFNLVLMPDNTVERFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 451 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSDEKDNLGLIFIKNNKYYLGVLRKENSKLFDYQITEKDNQKEKERKNNLKNEILANDNEDFYLKMNYWQIADPAKDIFNLVLMPDNTVARFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 452 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSDEKDNLGLIFIKNNKYYLGVLRKENSKLFDYQITEKDNQKEKERKNNLKNEILANDNEDFYLKMNYWQIADPAKDIFNLVLMPDNTVDRFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 453 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSDEKDNLGLIFIKNNKYYLGVLRKENSKLFDYQITEKDNQKEKERKNNLKNEILANDNEDFYLKMNYWQIADPAKDIFNLVLMPDNTVERFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 454 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSEEKDNLGLIFIKNNKYYLGVLRKENSKLFDYQITEKDNQKEKERKNNLKNEILANDNEDFYLKMNYWQIADPAKDIFNLVLMPDNTVARFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 455 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSEEKDNLGLIFIKNNKYYLGVLRKENSKLFDYQITEKDNQKEKERKNNLKNEILANDNEDFYLKMNYWQIADPAKDIFNLVLMPDNTVDRFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 456 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSEEKDNLGLIFIKNNKYYLGVLRKENSKLFDYQITEKDNQKEKERKNNLKNEILANDNEDFYLKMNYWQIADPAKDIFNLVLMPDNTVERFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 457 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSAEKDALGLIFIKNNKYYLGVLRKENSKLFDYQITEKDNQKEKERKNNLKNEILANDNEDFYLKMNYWQIADPAKDIFNLVLMPDNTVARFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 458 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSAEKDDLGLIFIKNNKYYLGVLRKENSKLFDYQITEKDNQKEKERKNNLKNEILANDNEDFYLKMNYWQIADPAKDIFNLVLMPDNTVARFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 459 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSAEKDELGLIFIKNNKYYLGVLRKENSKLFDYQITEKDNQKEKERKNNLKNEILANDNEDFYLKMNYWQIADPAKDIFNLVLMPDNTVARFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 460 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSAEKDALGLIFIKNNKYYLGVLRKENSKLFDYQITEKDNQKEKERKNNLKNEILANDNEDFYLKMNYWQIADPAKDIFNLVLMPDNTVDRFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 461 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSAEKDDLGLIFIKNNKYYLGVLRKENSKLFDYQITEKDNQKEKERKNNLKNEILANDNEDFYLKMNYWQIADPAKDIFNLVLMPDNTVDRFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 462 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSAEKDELGLIFIKNNKYYLGVLRKENSKLFDYQITEKDNQKEKERKNNLKNEILANDNEDFYLKMNYWQIADPAKDIFNLVLMPDNTVDRFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 463 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSAEKDALGLIFIKNNKYYLGVLRKENSKLFDYQITEKDNQKEKERKNNLKNEILANDNEDFYLKMNYWQIADPAKDIFNLVLMPDNTVERFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 464 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSAEKDDLGLIFIKNNKYYLGVLRKENSKLFDYQITEKDNQKEKERKNNLKNEILANDNEDFYLKMNYWQIADPAKDIFNLVLMPDNTVERFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 465 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSAEKDELGLIFIKNNKYYLGVLRKENSKLFDYQITEKDNQKEKERKNNLKNEILANDNEDFYLKMNYWQIADPAKDIFNLVLMPDNTVERFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 466 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSDEKDALGLIFIKNNKYYLGVLRKENSKLFDYQITEKDNQKEKERKNNLKNEILANDNEDFYLKMNYWQIADPAKDIFNLVLMPDNTVARFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 467 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSDEKDDLGLIFIKNNKYYLGVLRKENSKLFDYQITEKDNQKEKERKNNLKNEILANDNEDFYLKMNYWQIADPAKDIFNLVLMPDNTVARFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 468 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSDEKDELGLIFIKNNKYYLGVLRKENSKLFDYQITEKDNQKEKERKNNLKNEILANDNEDFYLKMNYWQIADPAKDIFNLVLMPDNTVARFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 469 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSDEKDALGLIFIKNNKYYLGVLRKENSKLFDYQITEKDNQKEKERKNNLKNEILANDNEDFYLKMNYWQIADPAKDIFNLVLMPDNTVDRFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 470 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSDEKDDLGLIFIKNNKYYLGVLRKENSKLFDYQITEKDNQKEKERKNNLKNEILANDNEDFYLKMNYWQIADPAKDIFNLVLMPDNTVDRFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 471 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSDEKDELGLIFIKNNKYYLGVLRKENSKLFDYQITEKDNQKEKERKNNLKNEILANDNEDFYLKMNYWQIADPAKDIFNLVLMPDNTVDRFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 472 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSDEKDALGLIFIKNNKYYLGVLRKENSKLFDYQITEKDNQKEKERKNNLKNEILANDNEDFYLKMNYWQIADPAKDIFNLVLMPDNTVERFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 473 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSDEKDDLGLIFIKNNKYYLGVLRKENSKLFDYQITEKDNQKEKERKNNLKNEILANDNEDFYLKMNYWQIADPAKDIFNLVLMPDNTVERFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 474 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSDEKDELGLIFIKNNKYYLGVLRKENSKLFDYQITEKDNQKEKERKNNLKNEILANDNEDFYLKMNYWQIADPAKDIFNLVLMPDNTVERFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 475 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSEEKDALGLIFIKNNKYYLGVLRKENSKLFDYQITEKDNQKEKERKNNLKNEILANDNEDFYLKMNYWQIADPAKDIFNLVLMPDNTVARFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 476 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSEEKDDLGLIFIKNNKYYLGVLRKENSKLFDYQITEKDNQKEKERKNNLKNEILANDNEDFYLKMNYWQIADPAKDIFNLVLMPDNTVARFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 477 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSEEKDELGLIFIKNNKYYLGVLRKENSKLFDYQITEKDNQKEKERKNNLKNEILANDNEDFYLKMNYWQIADPAKDIFNLVLMPDNTVARFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 478 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSEEKDALGLIFIKNNKYYLGVLRKENSKLFDYQITEKDNQKEKERKNNLKNEILANDNEDFYLKMNYWQIADPAKDIFNLVLMPDNTVDRFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 479 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSEEKDDLGLIFIKNNKYYLGVLRKENSKLFDYQITEKDNQKEKERKNNLKNEILANDNEDFYLKMNYWQIADPAKDIFNLVLMPDNTVDRFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 480 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSEEKDELGLIFIKNNKYYLGVLRKENSKLFDYQITEKDNQKEKERKNNLKNEILANDNEDFYLKMNYWQIADPAKDIFNLVLMPDNTVDRFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 481 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSEEKDALGLIFIKNNKYYLGVLRKENSKLFDYQITEKDNQKEKERKNNLKNEILANDNEDFYLKMNYWQIADPAKDIFNLVLMPDNTVERFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 482 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSEEKDDLGLIFIKNNKYYLGVLRKENSKLFDYQITEKDNQKEKERKNNLKNEILANDNEDFYLKMNYWQIADPAKDIFNLVLMPDNTVERFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 483 - protein, 1416 aa, unidentified
MENKNNQTQSIWSVFTKKYSLQKTLRFELKPVGETKKWLEENDIFKKDLNIDKSYNQAKFYFDKLHQDFIKESLSVENGIRNIDFEKFAKIFESNKEKIVSLKKKNKEVKDKNKKNWDEISKLEKEIEGQRENLYKEIRELFDKRAEKWKKEYQDKEIERGGKKEKIKFSSADLKQKGVNFLTAAGIINILKYKFPAEKDEEFRKEGYPSLFINDELNPGKKIYIFESFDKFTTYLSKFQQTRENLYKDDGTSTAVATRIVSNFERFLENKSLFEEKYKNKAKDVGLTKEEEKVFEINYYYDCLIQEGIDKYNKIIGEINRKTKEYRDKNKIDKKDLPLFLNLEKQILGEVKKERVFIEAKDEKTEEEVFIDRFQEFIKRNKIKIYGDEKEEIEGAKKFIEDFTSGIFENDYQSIYLKKNVINEIVNKWFSNPEEFLMKLTGVKSEEKIKLKKFTSLDEFKNAILSLEGDIFKSRFYKNEVNPEAPLEKEEKSNNWENFLKIWRFEFESLFKDKVEKGEIKKDKNGEPIQIFWGYTDKLEKEAEKIKFYSAEKEQIKTIKNYCDAALRINRMMRYFNLSDKDRKDVPSGLSTEFYRLVDEYFNNFEFNKYYNGIRNFITKKPSDENKIKLNFESRSLLDGWDVSEEKDELGLIFIKNNKYYLGVLRKENSKLFDYQITEKDNQKEKERKNNLKNEILANDNEDFYLKMNYWQIADPAKDIFNLVLMPDNTVERFTKLEEKNKHWPDEIKRIKEKGTYKREKVNREDLVKIINYFRKCALIYWKKFDLKLLPSEEYQTFKDFTDHIALQGYKINFDKIKASYIEKQLNDGNLYLFEVSNKDFYKYKKPDSRKNIHTLYWEHIFSKENLEEIKYPLIRLNGKAEIFYRDVLEMNEEMRKPVILERLNGAKQAKREDKPVYHYQRYLKPTYLFHCPITLNADKPSSSFKNFSSKLNHFIKDNLGKINIIGIDRGEKNLLYYCVINQNQEILDYGSLNKINLNKVNNVNYFDKLVEREKQRQLERQSWEPVAKIKDLKQGYISYVVRKICDLIINHNAIVVLEDLSRRFKQIRNGISERTVYQQFEKALIDKLNYLIFKDNRDVFSPGGVLNGYQLAAPFTSFKDIEKAKQTGVLFYTSAEYTSQTDPLTGFRKNIYISNSASQEKIKELINKLKKFGWDDTEESYFIEYNQVDFAEKKKKPLSKDWTIWTKVPRVIRWKESKSSYWSYKKINLNEEFRDLLEKYGFEAQSNDILSNLKKRIAENDKLLVEKKEFDGRLKNFYERFIFLFNIVLQVRNTYSLSVEIDKTEKKLKKIDYGIDFFASPVKPFFTTFGLREIGIEKDGKVVKDNAREEIASENLAEFKDRLKEYKPEEKFDADGVGAYNIARKGLIILEKIKNNPNKPDLSISKEEWDKFVQR

SEQ ID NO: 484 - protein, 1307 aa, Acidaminococcus sp.; identical to SEQ ID NO: 55

SEQ ID NO: 485 - protein, 1307 aa, Acidaminococcus sp.; identical to SEQ ID NO: 56

SEQ ID NO: 486 - protein, 1307 aa, Acidaminococcus sp.; identical to SEQ ID NO: 57

SEQ ID NO: 487 - protein, 1307 aa, Acidaminococcus sp.; identical to SEQ ID NO: 58

SEQ ID NO: 488 - protein, 1307 aa, Acidaminococcus sp.; identical to SEQ ID NO: 59

SEQ ID NO: 489 - protein, 1307 aa, Acidaminococcus sp.; identical to SEQ ID NO: 60

SEQ ID NO: 490 - protein, 1307 aa, Acidaminococcus sp.; identical to SEQ ID NO: 61

SEQ ID NO: 491 - protein, 1307 aa, Acidaminococcus sp.; identical to SEQ ID NO: 62

SEQ ID NO: 492 - protein, 1307 aa, Acidaminococcus sp.; identical to SEQ ID NO: 63

SEQ ID NO: 493 - protein, 1307 aa, Acidaminococcus sp.; identical to SEQ ID NO: 64

SEQ ID NO: 494 - protein, 1307 aa, Acidaminococcus sp.; identical to SEQ ID NO: 65

SEQ ID NO: 495 - protein, 1307 aa, Acidaminococcus sp.; identical to SEQ ID NO: 66

SEQ ID NO: 496 - protein, 1307 aa, Acidaminococcus sp.; identical to SEQ ID NO: 67

SEQ ID NO: 497 - protein, 1307 aa, Acidaminococcus sp.; identical to SEQ ID NO: 68

SEQ ID NO: 498 - protein, 1307 aa, Acidaminococcus sp.; identical to SEQ ID NO: 69

SEQ ID NO: 499 - protein, 1307 aa, Acidaminococcus sp.; identical to SEQ ID NO: 70

SEQ ID NO: 500 - protein, 1307 aa, Acidaminococcus sp.; identical to SEQ ID NO: 71

SEQ ID NO: 501 - protein, 1307 aa, Acidaminococcus sp.; identical to SEQ ID NO: 72

SEQ ID NO: 502 - protein, 1307 aa, Acidaminococcus sp.; identical to SEQ ID NO: 73

SEQ ID NO: 503 - protein, 1307 aa, Acidaminococcus sp.; identical to SEQ ID NO: 74

SEQ ID NO: 504 - protein, 1307 aa, Acidaminococcus sp.; identical to SEQ ID NO: 75

SEQ ID NO: 505 - protein, 1307 aa, Acidaminococcus sp.; identical to SEQ ID NO: 76

SEQ ID NO: 506 - protein, 1307 aa, Acidaminococcus sp.; identical to SEQ ID NO: 77

SEQ ID NO: 507 - protein, 1307 aa, Acidaminococcus sp.; identical to SEQ ID NO: 78

SEQ ID NO: 508 - protein, 1307 aa, Acidaminococcus sp.; identical to SEQ ID NO: 79

SEQ ID NO: 509 - protein, 1307 aa, Acidaminococcus sp.; identical to SEQ ID NO: 80

SEQ ID NO: 510 - protein, 1307 aa, Acidaminococcus sp.; identical to SEQ ID NO: 81

SEQ ID NO: 511 - protein, 1307 aa, Acidaminococcus sp.; identical to SEQ ID NO: 82

SEQ ID NO: 512 - protein, 1307 aa, Acidaminococcus sp.; identical to SEQ ID NO: 83

SEQ ID NO: 513 - protein, 1307 aa, Acidaminococcus sp.; identical to SEQ ID NO: 84

SEQ ID NO: 514 - protein, 1307 aa, Acidaminococcus sp.; identical to SEQ ID NO: 85

SEQ ID NO: 515 - protein, 1307 aa, Acidaminococcus sp.; identical to SEQ ID NO: 86

SEQ ID NO: 516 - protein, 1307 aa, Acidaminococcus sp.; identical to SEQ ID NO: 87

SEQ ID NO: 517 - protein, 1307 aa, Acidaminococcus sp.; identical to SEQ ID NO: 88

SEQ ID NO: 518 - protein, 1307 aa, Acidaminococcus sp.; identical to SEQ ID NO: 89

SEQ ID NO: 519 - protein, 1307 aa, Acidaminococcus sp.; identical to SEQ ID NO: 90

SEQ ID NO: 520 - protein, 1307 aa, Acidaminococcus sp.; identical to SEQ ID NO: 91

SEQ ID NO: 521 - protein, 1307 aa, Acidaminococcus sp.; identical to SEQ ID NO: 92

SEQ ID NO: 522 - protein, 1307 aa, Acidaminococcus sp.; identical to SEQ ID NO: 93

SEQ ID NO: 523 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNKEIDNTSVILRKRGLYYLAIMPQDNKNVFKKSPNLKNNESCFEKMDYKQMALPMGFGAFVRACFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 524 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNKEIDNTSVILRKRGLYYLAIMPQDNKNVFKKSPNLKNNESCFEKMDYKQMALPMGFGAFVRDCFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 525 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNKEIDNTSVILRKRGLYYLAIMPQDNKNVFKKSPNLKNNESCFEKMDYKQMALPMGFGAFVRECFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 526 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNAEIDNTSVILRKRGLYYLAIMPQDNKNVFKKSPNLKNNESCFEKMDYKQMALPMGFGAFVRACFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 527 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNAEIDNTSVILRKRGLYYLAIMPQDNKNVFKKSPNLKNNESCFEKMDYKQMALPMGFGAFVRDCFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 528 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNAEIDNTSVILRKRGLYYLAIMPQDNKNVFKKSPNLKNNESCFEKMDYKQMALPMGFGAFVRECFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 529 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNDEIDNTSVILRKRGLYYLAIMPQDNKNVFKKSPNLKNNESCFEKMDYKQMALPMGFGAFVRACFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 530 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNDEIDNTSVILRKRGLYYLAIMPQDNKNVFKKSPNLKNNESCFEKMDYKQMALPMGFGAFVRDCFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 531 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNDEIDNTSVILRKRGLYYLAIMPQDNKNVFKKSPNLKNNESCFEKMDYKQMALPMGFGAFVRECFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 532 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNEEIDNTSVILRKRGLYYLAIMPQDNKNVFKKSPNLKNNESCFEKMDYKQMALPMGFGAFVRACFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 533 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNEEIDNTSVILRKRGLYYLAIMPQDNKNVFKKSPNLKNNESCFEKMDYKQMALPMGFGAFVRDCFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 534 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNEEIDNTSVILRKRGLYYLAIMPQDNKNVFKKSPNLKNNESCFEKMDYKQMALPMGFGAFVRECFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 535 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNAEIDATSVILRKRGLYYLAIMPQDNKNVFKKSPNLKNNESCFEKMDYKQMALPMGFGAFVRACFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 536 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNAEIDDTSVILRKRGLYYLAIMPQDNKNVFKKSPNLKNNESCFEKMDYKQMALPMGFGAFVRACFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 537 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNAEIDETSVILRKRGLYYLAIMPQDNKNVFKKSPNLKNNESCFEKMDYKQMALPMGFGAFVRACFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 538 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNAEIDATSVILRKRGLYYLAIMPQDNKNVFKKSPNLKNNESCFEKMDYKQMALPMGFGAFVRDCFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 539 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNAEIDDTSVILRKRGLYYLAIMPQDNKNVFKKSPNLKNNESCFEKMDYKQMALPMGFGAFVRDCFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 540 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNAEIDETSVILRKRGLYYLAIMPQDNKNVFKKSPNLKNNESCFEKMDYKQMALPMGFGAFVRDCFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 541 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNAEIDATSVILRKRGLYYLAIMPQDNKNVFKKSPNLKNNESCFEKMDYKQMALPMGFGAFVRECFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 542 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNAEIDDTSVILRKRGLYYLAIMPQDNKNVFKKSPNLKNNESCFEKMDYKQMALPMGFGAFVRECFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 543 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNAEIDETSVILRKRGLYYLAIMPQDNKNVFKKSPNLKNNESCFEKMDYKQMALPMGFGAFVRECFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 544 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNDEIDATSVILRKRGLYYLAIMPQDNKNVFKKSPNLKNNESCFEKMDYKQMALPMGFGAFVRACFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 545 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNDEIDDTSVILRKRGLYYLAIMPQDNKNVFKKSPNLKNNESCFEKMDYKQMALPMGFGAFVRACFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 546 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNDEIDETSVILRKRGLYYLAIMPQDNKNVFKKSPNLKNNESCFEKMDYKQMALPMGFGAFVRACFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 547 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNDEIDATSVILRKRGLYYLAIMPQDNKNVFKKSPNLKNNESCFEKMDYKQMALPMGFGAFVRDCFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 548 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNDEIDDTSVILRKRGLYYLAIMPQDNKNVFKKSPNLKNNESCFEKMDYKQMALPMGFGAFVRDCFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 549 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNDEIDETSVILRKRGLYYLAIMPQDNKNVFKKSPNLKNNESCFEKMDYKQMALPMGFGAFVRDCFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 550 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNDEIDATSVILRKRGLYYLAIMPQDNKNVFKKSPNLKNNESCFEKMDYKQMALPMGFGAFVRECFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 551 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNDEIDDTSVILRKRGLYYLAIMPQDNKNVFKKSPNLKNNESCFEKMDYKQMALPMGFGAFVRECFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 552 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNDEIDETSVILRKRGLYYLAIMPQDNKNVFKKSPNLKNNESCFEKMDYKQMALPMGFGAFVRECFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 553 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNEEIDATSVILRKRGLYYLAIMPQDNKNVFKKSPNLKNNESCFEKMDYKQMALPMGFGAFVRACFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 554 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNEEIDDTSVILRKRGLYYLAIMPQDNKNVFKKSPNLKNNESCFEKMDYKQMALPMGFGAFVRACFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 555 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNEEIDETSVILRKRGLYYLAIMPQDNKNVFKKSPNLKNNESCFEKMDYKQMALPMGFGAFVRACFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 556 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNEEIDATSVILRKRGLYYLAIMPQDNKNVFKKSPNLKNNESCFEKMDYKQMALPMGFGAFVRDCFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 557 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNEEIDDTSVILRKRGLYYLAIMPQDNKNVFKKSPNLKNNESCFEKMDYKQMALPMGFGAFVRDCFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 558 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNEEIDETSVILRKRGLYYLAIMPQDNKNVFKKSPNLKNNESCFEKMDYKQMALPMGFGAFVRDCFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 559 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNEEIDATSVILRKRGLYYLAIMPQDNKNVFKKSPNLKNNESCFEKMDYKQMALPMGFGAFVRECFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 560 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNEEIDDTSVILRKRGLYYLAIMPQDNKNVFKKSPNLKNNESCFEKMDYKQMALPMGFGAFVRECFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 561 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNEEIDETSVILRKRGLYYLAIMPQDNKNVFKKSPNLKNNESCFEKMDYKQMALPMGFGAFVRECFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 562 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNKERDNKAAILRKDGKYYLAILDMKKDLSSIRTSDEDESSFEKMEYKLLPSPVKMLPAIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 563 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNKERDNKAAILRKDGKYYLAILDMKKDLSSIRTSDEDESSFEKMEYKLLPSPVKMLPDIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 564 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNKERDNKAAILRKDGKYYLAILDMKKDLSSIRTSDEDESSFEKMEYKLLPSPVKMLPEIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 565 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNAERDNKAAILRKDGKYYLAILDMKKDLSSIRTSDEDESSFEKMEYKLLPSPVKMLPAIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 566 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNAERDNKAAILRKDGKYYLAILDMKKDLSSIRTSDEDESSFEKMEYKLLPSPVKMLPDIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 567 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNAERDNKAAILRKDGKYYLAILDMKKDLSSIRTSDEDESSFEKMEYKLLPSPVKMLPEIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 568 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNDERDNKAAILRKDGKYYLAILDMKKDLSSIRTSDEDESSFEKMEYKLLPSPVKMLPAIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 569 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNDERDNKAAILRKDGKYYLAILDMKKDLSSIRTSDEDESSFEKMEYKLLPSPVKMLPDIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 570 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNDERDNKAAILRKDGKYYLAILDMKKDLSSIRTSDEDESSFEKMEYKLLPSPVKMLPEIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 571 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNEERDNKAAILRKDGKYYLAILDMKKDLSSIRTSDEDESSFEKMEYKLLPSPVKMLPAIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 572 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNEERDNKAAILRKDGKYYLAILDMKKDLSSIRTSDEDESSFEKMEYKLLPSPVKMLPDIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 573 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNEERDNKAAILRKDGKYYLAILDMKKDLSSIRTSDEDESSFEKMEYKLLPSPVKMLPEIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 574 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNAERDAKAAILRKDGKYYLAILDMKKDLSSIRTSDEDESSFEKMEYKLLPSPVKMLPAIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 575 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNAERDDKAAILRKDGKYYLAILDMKKDLSSIRTSDEDESSFEKMEYKLLPSPVKMLPAIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 576 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNAERDEKAAILRKDGKYYLAILDMKKDLSSIRTSDEDESSFEKMEYKLLPSPVKMLPAIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 577 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNAERDAKAAILRKDGKYYLAILDMKKDLSSIRTSDEDESSFEKMEYKLLPSPVKMLPDIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 578 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNAERDDKAAILRKDGKYYLAILDMKKDLSSIRTSDEDESSFEKMEYKLLPSPVKMLPDIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 579 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNAERDEKAAILRKDGKYYLAILDMKKDLSSIRTSDEDESSFEKMEYKLLPSPVKMLPDIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 580 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNAERDAKAAILRKDGKYYLAILDMKKDLSSIRTSDEDESSFEKMEYKLLPSPVKMLPEIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 581 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNAERDDKAAILRKDGKYYLAILDMKKDLSSIRTSDEDESSFEKMEYKLLPSPVKMLPEIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 582 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNAERDEKAAILRKDGKYYLAILDMKKDLSSIRTSDEDESSFEKMEYKLLPSPVKMLPEIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 583 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNDERDAKAAILRKDGKYYLAILDMKKDLSSIRTSDEDESSFEKMEYKLLPSPVKMLPAIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 584 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNDERDDKAAILRKDGKYYLAILDMKKDLSSIRTSDEDESSFEKMEYKLLPSPVKMLPAIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 585 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNDERDEKAAILRKDGKYYLAILDMKKDLSSIRTSDEDESSFEKMEYKLLPSPVKMLPAIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 586 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNDERDAKAAILRKDGKYYLAILDMKKDLSSIRTSDEDESSFEKMEYKLLPSPVKMLPDIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 587 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNDERDDKAAILRKDGKYYLAILDMKKDLSSIRTSDEDESSFEKMEYKLLPSPVKMLPDIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 588 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNDERDEKAAILRKDGKYYLAILDMKKDLSSIRTSDEDESSFEKMEYKLLPSPVKMLPDIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 589 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNDERDAKAAILRKDGKYYLAILDMKKDLSSIRTSDEDESSFEKMEYKLLPSPVKMLPEIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 590 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNDERDDKAAILRKDGKYYLAILDMKKDLSSIRTSDEDESSFEKMEYKLLPSPVKMLPEIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 591 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNDERDEKAAILRKDGKYYLAILDMKKDLSSIRTSDEDESSFEKMEYKLLPSPVKMLPEIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 592 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNEERDAKAAILRKDGKYYLAILDMKKDLSSIRTSDEDESSFEKMEYKLLPSPVKMLPAIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 593 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNEERDDKAAILRKDGKYYLAILDMKKDLSSIRTSDEDESSFEKMEYKLLPSPVKMLPAIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 594 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNEERDEKAAILRKDGKYYLAILDMKKDLSSIRTSDEDESSFEKMEYKLLPSPVKMLPAIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 595 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNEERDAKAAILRKDGKYYLAILDMKKDLSSIRTSDEDESSFEKMEYKLLPSPVKMLPDIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 596 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNEERDDKAAILRKDGKYYLAILDMKKDLSSIRTSDEDESSFEKMEYKLLPSPVKMLPDIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 597 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNEERDEKAAILRKDGKYYLAILDMKKDLSSIRTSDEDESSFEKMEYKLLPSPVKMLPDIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 598 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNEERDAKAAILRKDGKYYLAILDMKKDLSSIRTSDEDESSFEKMEYKLLPSPVKMLPEIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 599 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNEERDDKAAILRKDGKYYLAILDMKKDLSSIRTSDEDESSFEKMEYKLLPSPVKMLPEIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 600 - protein, 1227 aa, unidentified
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNEERDEKAAILRKDGKYYLAILDMKKDLSSIRTSDEDESSFEKMEYKLLPSPVKMLPEIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 601 - DNA, 41 bp, synthetic construct
  source 1..41: mol_type = other DNA
gatccattttattttagatcatatatatacatgatcggatc

SEQ ID NO: 602 - DNA, 43 bp, synthetic construct
  source 1..43: mol_type = other DNA
cgatccattttattttagatcatatatatacatgatcggatcg

SEQ ID NO: 603 - DNA, 45 bp, synthetic construct
  source 1..45: mol_type = other DNA
ccgatccattttattttagatcatatatatacatgatcggatcgg

SEQ ID NO: 604 - DNA, 43 bp, synthetic construct
  source 1..43: mol_type = other DNA
agatccattttattttagatcatatatatacatgatcggatct

SEQ ID NO: 605 - DNA, 45 bp, synthetic construct
  source 1..45: mol_type = other DNA
atgatccattttattttagatcatatatatacatgatcggatcat

SEQ ID NO: 606 - DNA, 45 bp, synthetic construct
  source 1..45: mol_type = other DNA
gatatataaaaaaaaaaagatcatatacatatatgatcatatatc

SEQ ID NO: 607 - DNA, 47 bp, synthetic construct
  source 1..47: mol_type = other DNA
cgatatataaaaaaaaaaagatcatatacatatatgatcatatatcg

SEQ ID NO: 608 - DNA, 49 bp, synthetic construct
  source 1..49: mol_type = other DNA
ccgatatataaaaaaaaaaagatcatatacatatatgatcatatatcgg

SEQ ID NO: 609 - DNA, 47 bp, synthetic construct
  source 1..47: mol_type = other DNA
agatatataaaaaaaaaaagatcatatacatatatgatcatatatct

SEQ ID NO: 610 - DNA, 49 bp, synthetic construct
  source 1..49: mol_type = other DNA
atgatatataaaaaaaaaaagatcatatacatatatgatcatatatcat

SEQ ID NO: 611 - DNA, 43 bp, synthetic construct
  source 1..43: mol_type = other DNA
tgatccattttattttagatcatatatatacatgatcggatca

SEQ ID NO: 612 - DNA, 45 bp, synthetic construct
  source 1..45: mol_type = other DNA
tcgatccattttattttagatcatatatatacatgatcggatcga

SEQ ID NO: 613 - DNA, 47 bp, synthetic construct
  source 1..47: mol_type = other DNA
tgatatataaaaaaaaaaagatcatatacatatatgatcatatatca

SEQ ID NO: 614 - DNA, 49 bp, synthetic construct
  source 1..49: mol_type = other DNA
tcgatatataaaaaaaaaaagatcatatacatatatgatcatatatcga

SEQ ID NO: 615 - DNA, 2007 bp, Staphylococcus aureus
  source 1..2007: mol_type = genomic DNA
atgaaaaagataaaaattgttccacttattttaatagttgtagttgtcgggtttggtatatatttttatgcttcaaaagataaagaaattaataatactattgatgcaattgaagataaaaatttcaaacaagtttataaagatagcagttatatttctaaaagcgataatggtgaagtagaaatgactgaacgtccgataaaaatatataatagtttaggcgttaaagatataaacattcaggatcgtaaaataaaaaaagtatctaaaaataaaaaacgagtagatgctcaatataaaattaaaacaaactacggtaacattgatcgcaacgttcaatttaattttgttaaagaagatggtatgtggaagttagattgggatcatagcgtcattattccaggaatgcagaaagaccaaagcatacatattgaaaatttaaaatcagaacgtggtaaaattttagaccgaaacaatgtggaattggccaatacaggaacagcatatgagataggcatcgttccaaagaatgtatctaaaaaagattataaagcaatcgctaaagaactaagtatttctgaagactatatcaaacaacaaatggatcaaaattgggtacaagatgataccttcgttccacttaaaaccgttaaaaaaatggatgaatatttaagtgatttcgcaaaaaaatttcatcttacaactaatgaaacagaaagtcgtaactatcctctaggaaaagcgacttcacatctattaggttatgttggtcccattaactctgaagaattaaaacaaaaagaatataaaggctataaagatgatgcagttattggtaaaaagggactcgaaaaactttacgataaaaagctccaacatgaagatggctatcgtgtcacaatcgttgacgataatagcaatacaatcgcacatacattaatagagaaaaagaaaaaagatggcaaagatattcaactaactattgatgctaaagttcaaaagagtatttataacaacatgaaaaatgattatggctcaggtactgctatccaccctcaaacaggtgaattattagcacttgtaagcacaccttcatatgacgtctatccatttatgtatggcatgagtaacgaagaatataataaattaaccgaagataaaaaagaacctctgctcaacaagttccagattacaacttcaccaggttcaactcaaaaaatattaacagcaatgattgggttaaataacaaaacattagacgataaaacaagttataaaatcgatggtaaaggttggcaaaaagataaatcttggggtggttacaacgttacaagatatgaagtggtaaatggtaatatcgacttaaaacaagcaatagaatcatcagataacattttctttgctagagtagcactcgaattaggcagtaagaaatttgaaaaaggcatgaaaaaactaggtgttggtgaagatataccaagtgattatccattttataatgctcaaatttcaaacaaaaatttagataatgaaatattattagctgattcaggttacggacaaggtgaaatactgattaacccagtacagatcctttcaatctatagcgcattagaaaataatggcaatattaacgcacctcacttattaaaagacacgaaaaacaaagtttggaagaaaaatattatttccaaagaaaatatcaatctattaactgatggtatgcaacaagtcgtaaataaaacacataaagaagatatttatagatcttatgcaaacttaattggcaaatccggtactgcagaactcaaaatgaaacaaggagaaactggcagacaaattgggtggtttatatcatatgataaagataatccaaacatgatgatggctattaatgttaaagatgtacaagataaaggaatggctagctacaatgccaaaatctcaggtaaagtgtatgatgagctatatgagaacggtaataaaaaatacgatatagatgaataa

SEQ ID NO: 616 - DNA, 20 bp, Staphylococcus aureus
  source 1..20: mol_type = genomic DNA
tgtatggcatgagtaacgaa

SEQ ID NO: 617 - DNA, 64 bp, synthetic construct
  source 1..64: mol_type = other DNA
gccttcagaagagggtgcattttcaggaggaagcgatggcttcagacagcatatttgagtcatt

SEQ ID NO: 618 - DNA, 64 bp, synthetic construct
  source 1..64: mol_type = other DNA
gccttcagaagagggtgcatgcacaggaggaagcgatggcttcagacagcatatttgagtcatt

SEQ ID NO: 619 - DNA, 22 bp, synthetic construct
  source 1..22: mol_type = other DNA
aggaggaagcgatggcttcaga

SEQ ID NO: 620 - RNA, 44 nt, synthetic construct
  source 1..44: mol_type = other RNA
gtaatttctactaagtgtagataggaggaagcgatggcttcaga

We claim:

1. A method for preventing unwinding of blocked nucleic acid molecules in the presence of an RNP comprising the steps of:
providing blocked nucleic acid molecules;
providing ribonucleoprotein complexes comprising a Cas12a nucleic acid-guided nuclease that exhibits both cis- and trans-cleavage activity upon activation and a gRNA that recognizes an unblocked nucleic acid molecule resulting from trans-cleavage of the blocked nucleic acid molecules; and
engineering the nucleic acid-guided nuclease used in the ribonucleoprotein complex to result in a variant nucleic acid-guided nuclease where single stranded DNA is cleaved faster than double stranded DNA is cleaved.

2. The method of claim 1, wherein the blocked nucleic acid molecules comprise a structure represented by any one of Formulas I-IV, wherein Formulas I-IV are in the 5'-to-3' direction:

(a) A-(B-L)$_J$-C-M-T-D  (Formula I);

wherein A is 0-15 nucleotides in length;
B is 4-12 nucleotides in length;
L is 3-25 nucleotides in length;
J is an integer between 1 and 10;
C is 4-15 nucleotides in length;
M is 1-25 nucleotides in length or is absent, wherein if M is absent then A-(B-L)$_J$-C and T-D are separate nucleic acid strands;
T is 17-135 nucleotides in length and comprises at least 50% sequence complementarity to B and C; and
D is 0-10 nucleotides in length and comprises at least 50% sequence complementarity to A;

(b) D-T-T'-C-(L-B)$_J$-A  (Formula II);

wherein D is 0-10 nucleotides in length;
T-T' is 17-135 nucleotides in length;
T' is 1-10 nucleotides in length and does not hybridize with T;
C is 4-15 nucleotides in length and comprises at least 50% sequence complementarity to T;
L is 3-25 nucleotides in length and does not hybridize with T;
B is 4-12 nucleotides in length and comprises at least 50% sequence complementarity to T;
J is an integer between 1 and 10;
A is 0-15 nucleotides in length and comprises at least 50% sequence complementarity to D;

(c) T-D-M-A-(B-L)$_J$-C  (Formula III);

wherein T is 17-135 nucleotides in length;
D is 0-10 nucleotides in length;
M is 1-25 nucleotides in length or is absent, wherein if M is absent then T-D and A-(B-L)$_J$-C are separate nucleic acid strands;
A is 0-15 nucleotides in length and comprises at least 50% sequence complementarity to D;
B is 4-12 nucleotides in length and comprises at least 50% sequence complementarity to T;
L is 3-25 nucleotides in length;
J is an integer between 1 and 10; and
C is 4-15 nucleotides in length; or (d) T-D-M-A-L$_p$-C  (Formula IV);

wherein T is 17-31 nucleotides in length (e.g., 17-100, 17-50, or 17-25);
D is 0-15 nucleotides in length;
M is 1-25 nucleotides in length;
A is 0-15 nucleotides in length and comprises a sequence complementary to D; and
L is 3-25 nucleotides in length;
p is 0 or 1;
C is 4-15 nucleotides in length and comprises a sequence complementary to T.

3. The method of claim 1, wherein the RNP comprises a variant nucleic acid-guided nuclease comprising at least one mutation to the domains that interact with the PAM region or surrounding sequences on the blocked nucleic acid molecule and wherein the mutation is selected from mutations to amino acid residues K538, Y542 and K595 in relation to SEQ ID NO:1 and equivalent amino acid residues in orthologs.

4. The method of claim 3, wherein there are at least two mutations to the domains that interact with the PAM region or surrounding sequences on the blocked nucleic acid molecules selected from mutations to amino acid residues K538, Y542 and K595 in relation to SEQ ID NO:1 and equivalent amino acid residues in orthologs.

5. The method of claim 4, wherein there are at least three mutations to domains that interact with the PAM region or surrounding sequences on the blocked nucleic acid molecule selected from mutations to amino acid residues K538, Y542 and K595 in relation to SEQ ID NO:1 and equivalent amino acid residues in orthologs.

* * * * *